United States Patent
Olek et al.

(10) Patent No.: US 10,208,346 B2
(45) Date of Patent: Feb. 19, 2019

(54) METHOD FOR IDENTIFYING THE QUANTITATIVE CELLULAR COMPOSITION IN A BIOLOGICAL SAMPLE

(71) Applicant: EPIONTIS GMBH, Berlin (DE)

(72) Inventors: Sven Olek, Boothstrasse (DE); Ulrich Hoffmueller, Berlin (DE)

(73) Assignee: EPIONTIS GMBH, Berlin (DE)

( * ) Notice: Subject to any disclaimer, the term of this patent is extended or adjusted under 35 U.S.C. 154(b) by 0 days.

(21) Appl. No.: 14/771,496

(22) PCT Filed: Apr. 22, 2014

(86) PCT No.: PCT/EP2014/058087
§ 371 (c)(1),
(2) Date: Aug. 30, 2015

(87) PCT Pub. No.: WO2014/170497
PCT Pub. Date: Oct. 23, 2014

(65) Prior Publication Data
US 2016/0024578 A1 Jan. 28, 2016

Related U.S. Application Data

(60) Provisional application No. 61/813,802, filed on Apr. 19, 2013.

(30) Foreign Application Priority Data

Jun. 24, 2013 (EP) .................................... 13173442

(51) Int. Cl.
*C12Q 1/6881* (2018.01)

(52) U.S. Cl.
CPC ..... *C12Q 1/6881* (2013.01); *C12Q 2600/154* (2013.01)

(58) Field of Classification Search
None
See application file for complete search history.

(56) References Cited

U.S. PATENT DOCUMENTS 5,773,290 A * 6/1998 Gould .................... C07K 14/47
435/320.1

FOREIGN PATENT DOCUMENTS

| WO | WO 2008073303 A2 * | 6/2008 | ......... C12N 15/1051 |
| WO | WO 2011095564 A1 * | 8/2011 | .......... C12Q 1/6881 |
| WO | WO 2013/014122 A1 | 1/2013 | |

OTHER PUBLICATIONS

Oturai et al. Scandinavian Journal of Immunology. 2015. 83:72-80. (Year: 2015).*
Baron, Udo et al., "DNA demethylation in the human FOXP3 locus discriminates regulatory T cells from activated FOXP3+ conventional T cells," *European Journal of Immunology*, 2007,37(9):2378-2389.
Baron, Udo et al., "Dna methylation analysis as a tool for cell typing,"*Epigenetics: Official Journal of the DNA Methylation Society, Landes Bioscience*, 2006, 1(1):55-60.
Sehouli, Jalid et al., "Epigenetic quantification of tumor-infiltrating T-lymphocytes," *Epigenetics, Landes Bioscience*, 2011, 6(2):236-246.
Wieczorek, Georg et al., "Quantitative DNA methylation analysis of FOXP3 as a new method for counting regulatory T cells in peripheral blood and solid tissue," *Cancer Research, American Association for Cancer Research*, 2009, 69(2):599-608.

* cited by examiner

*Primary Examiner* — Joseph G. Dauner
(74) *Attorney, Agent, or Firm* — Saliwanchik, Lloyd & Eisenschenk

(57) ABSTRACT

The present invention provides an epigenetic haemogram, also referred to as an epigenetic blood cell count that identifies the quantitative, comprehensive picture of cellular composition in a biological sample, wherein advantageously a normalization standard is used. The normalization standard is a nucleic acid molecule comprising at least one marker-region being specific for each of the blood cells to be detected, and at least one control-region being cell-unspecific, wherein said regions are present in the same number of copies on said molecule and/or a natural blood cell sample of known composition. Furthermore, the present invention relates to a kit and the use of a kit for performing the epigenetic assessment of comprehensive, quantitative cellular composition of a biological sample. The biological sample is derived from e.g. a mammalian body fluid, including peripheral, capillary or venous blood samples or subfractions thereof, such as peripheral blood mononuclear cells or peripheral blood monocytes, or a tissue sample, organ sample, or from frozen, dried, embedded, stored or fresh body fluids or tissue samples.

Figure 1:
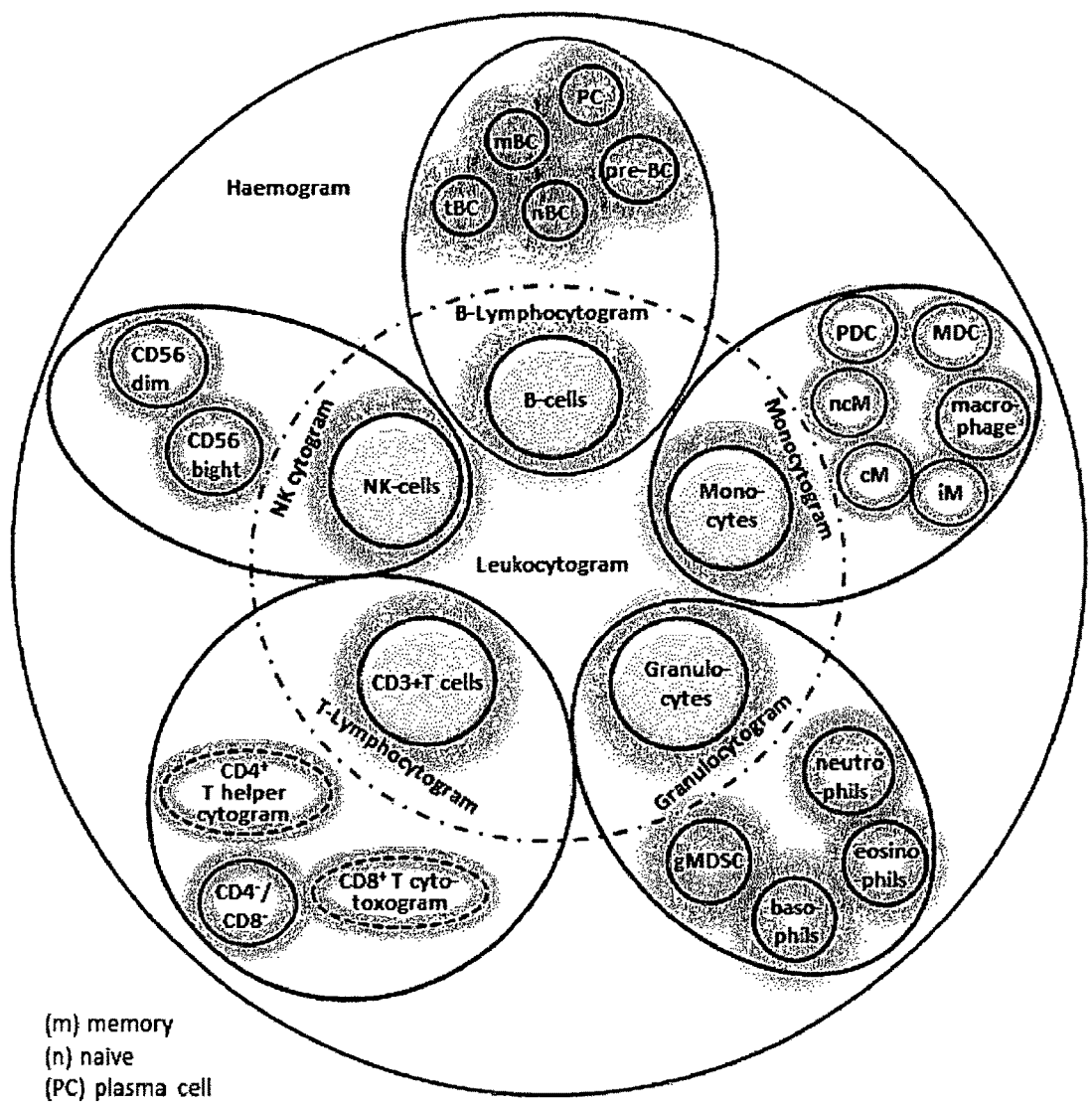

13 Claims, 4 Drawing Sheets
Specification includes a Sequence Listing.

(m) memory
(n) naive
(PC) plasma cell
(tBC) transitional B-cells
(cM) Classical monocytes
(iM) intermediate monocytes
(ncM) non-classical monocytes
(PDC) plasmacytoid dendritic cell
(MDC) myeloid dendritic cell
(gMDSC) granulocytic myeloid-derived suppressor cells
(mMDSC) monocytic myeloid-derived suppressor cells

METHOD FOR IDENTIFYING THE QUANTITATIVE CELLULAR COMPOSITION IN A BIOLOGICAL SAMPLE

CROSS REFERENCE TO RELATED APPLICATIONS

This application is a National Stage Application of International Application Number PCT/EP2014/058087, filed Apr. 22, 2014; which claims the benefit of U.S. Provisional Application No. 61/813,802, filed Apr. 19, 2014; and which claims priority to European Application No. 13173442.8, filed Jun. 24, 2013; all of which are incorporated herein by reference in their entirety.

The Sequence Listing for this application is labeled "SeqList-15Feb18-ST25.txt", which was created on Feb. 15, 2018, and is 654 KB. The Sequence Listing is incorporated herein by reference in its entirety.

The present invention provides an epigenetic haemogram, also referred to as an epigenetic blood cell count that identifies the quantitative, comprehensive picture of cellular composition in a biological sample, wherein advantageously a normalization standard is used. The normalization standard is a nucleic acid molecule comprising at least one marker-region being specific for each of the blood and/or immune cells to be detected, and at least one control-region being cell-unspecific, wherein said regions are present in the same number of copies on said molecule and/or a natural blood cell sample of known composition. Furthermore, the present invention relates to a kit and the use of a kit for performing the epigenetic assessment of comprehensive, quantitative cellular composition of a biological sample. The biological sample is derived from e.g. a mammalian body fluid, including peripheral, capillary or venous blood samples or subfractions thereof, such as peripheral blood mononuclear cells or peripheral blood monocytes, or a tissue sample, organ sample, or from frozen, dried, embedded, stored or fresh body fluids or tissue samples.

BACKGROUND OF THE INVENTION

A "blood count", "complete blood count", or "blood cell profile" commonly designates a set of tests to determine the number, ratio and appearances of blood cells and/or their cellular subgroups (e.g., neutrophils, eosinophils, basophils, CD19 or CD3 cells, and their subgroups, such as $CD3^+CD4^+$ and/or $CD3^+/CD8^+$ cells). Such a blood count is used in clinical diagnostics as a broad screening test for disorders or a determination of the general health status of an individual. In general, a "blood count" includes assays directed at hematocrit, quantification of hemoglobin, total blood cells, and red blood cell index (e.g. mean corpuscular volume, mean corpuscular hemoglobin, mean corpuscular hemoglobin concentration, red blood cell distribution).

White blood cells (also referred to as leukocytes) are part of the cellular immune system (we explicitly define all immune cells, including B-cells as cellular immune system) and play a key role in defending an mammals from pathological effects caused either by foreign organisms (in particular for example: viruses, bacteria, parasites, etc.), but also from aberrations of diseased self-cells, such as tumor cells. In addition, immune cells are themselves subject to diseases, either as primary (congenital) immune diseases, such as the IPEX syndrome or as secondary (acquired) immune diseases, such as for example AIDS, HIV. In the former, the immune system itself is impaired, whereas in the latter external factors (such as virus infections, radiation, chemotherapies or environmental factors) lead to a weakening of the immune system. Several types of leukocytes exist and they either derive from the myeloid lineage—e.g. neutrophil, eosinophil and basophil granulocytes, mast cells and macrophages—or derive from the lymphoid lineage including all lymphocyte subpopulations—such as for example T-cells, B-cells, NK cells. Since the composition of the immune system, and its cellular members, has been subjected to many analyses, aberrations of this normal immune cell count (or ratio) can be recognized easily, is used diagnostically, and may be used for clinical decision-making. Thus, the ratio and count of these cells are regularly analyzed in clinical settings—both as routine diagnostic or analytical tool as well as in clinical research or trials—in order to detect any abnormalities or apparent changes that may be caused by a disease or a disease treatment or other internal or external factors. For example, blood counts are used to diagnose the onset/occurence of leuko- or lymphopenias or leuko- or lymphocytosis, such as granulocytosis. Furthermore, blood counts are taken to monitor the treatment success of all diseases that result from, cause or whose treatment may result in changes of the overall or specific leuko- or lymphocyte counts. For example, for diagnosing or monitoring infections, anemia, leukemia or the effects of chemotherapies, a so-called "differential" whole blood count is used in order to analyze and identify immune cells and subpopulations thereof. In some primary and secondary immune disorders, this procedure may be the only available diagnostic tool. The differential blood count includes assays directed at a quantification of total white blood cells, neutrophil granulocytes, lymphocytes, monocytes, eosinophil granulocytes, and basophil granulocytes.

Routinely, for soluble cells, i.e., mainly blood but also solubilized tissues or body fluids such a specific immune cell profile is measured by flow cytometry, or by immunohistochemistry (IHC) for solid tissues. Both technologies work on the basis of protein epitopes exposed on cell membranes that are specific for each subtype of cell subpopulation. Recently, research focused on the biological role of leukocyte subpopulations, and this results in a strong demand for clinical as well as for research applications allowing to identifying such populations.

Technically, in routine diagnostics, hematocrit, hemoglobin as well as total white blood counts are determined by an automatic cell counter based on light detection and electrical impedance. A differential white blood count, including neutrophil, eosinophil, basophil granulocytes, monocytes and mast cells are determined either via manual microscopic counting or automatic counting of blood smears.

Additional methods, allowing for the detection of T cell populations are MHC multimetric analyses, the Cytokine-Capture Assay, individual T cell detections (ELISPOT-Assay) or the merely qualitative detection and localization of immune cells (immunohistochemical analyses). Like flow cytometry, these assays are based on a detection of proteins; no specific expression level-independent markers are used. It is noteworthy that all of these assays as well as all assays based on the detection of mRNA, vary from cell to cell. This is because even cells that are undoubtedly positive for a certain protein present time wise varying amounts of protein. Hence, a threshold for "positivity" has to be determined for each and every protein marker depending on the affinity and unspecific binding properties of the given antibody as well as on the average amount of surface expression of the target protein.

Even though almost all cells in an individual contain the exact same complement/composition of DNA code, higher organisms must impose and maintain different patterns of gene expression in the various types of tissue. Most gene regulation is transitory, depending on the current state of the cell and changes in external stimuli. Persistent regulation, on the other hand, is a primary role of epigenetics—heritable regulatory patterns that do not alter the basic genetic coding of the DNA. DNA methylation is the archetypical form of epigenetic regulation; it serves as the stable memory for cells and performs a crucial role in maintaining the long-term identity of various cell types. Recently, other forms of epigenetic regulation were discovered. In addition to the "fifth base" 5-methylcytosine (mC), a sixth (5-hydroxymethylcytosine, hmC), seventh (5-formylcytosine, fC) and eighth (5-carboxycytosine, cC) can be found (Michael J. Booth et al. Quantitative Sequencing of 5-Methylcytosine and 5-Hydroxymethylcytosine at Single-Base Resolution Science 18 May 2012, Vol. 336 no. 6083 pp. 934-937). The primary target of mentioned DNA modifications is the two-nucleotide sequence Cytosine-Guanine (a 'CpG site'); within this context cytosine (C) can undergo a simple chemical modification to become formylated, methylated, hydroxymethylated, or carboxylated. In the human genome, the CG sequence is much rarer than expected, except in certain relatively dense clusters called 'CpG islands'. CpG islands are frequently associated with gene promoters, and it has been estimated that more than half of the human genes have CpG islands (Antequera and Bird, Proc Natl Acad Sci USA 90: 11995-9, 1993).

For one of the recently described modification of cytosine, 5-hydroxymethylation, the utility of oxidative bisulfite sequencing to map and quantify 5hmC at CpG islands was shown (Michael J. Booth et al. Quantitative Sequencing of 5-Methylcytosine and 5-Hydroxymethylcytosine at Single-Base Resolution Science 18 May 2012, Vol. 336 no. 6083 pp. 934-937).

In the context of the present invention, the term "bisultite convertible chromatin" shall mean a chromatin structure (e.g. a sufficiently opened structure) that allows bisulfite to chemically modify cytosines. Consequently, the term "DNA bisulfite convertibility" relates to the extent of cytosine bases in said chromatin and/or the respective nucleic acid that is part of said chromatin, that can be (or have been) converted using a bisulfite treatment. The term also relates to the extent of cytosine bases in a reference nucleic acid (such as a plasmid) that can be (or have been) converted using a bisulfite treatment. In turn, the term "non-bisulfite convertible chromatin" or "non-bisulfite convertible nucleic acid" relates to the extent of cytosine bases that cannot be (or could not been) converted using a bisulfite treatment.

As mentioned above, recently three new cytosine modifications were discovered. Therefore, it is expected that future scientific findings will lead to a more precise interpretation of epigenetic patterns of bisulfite convertibility described in the past. These past result of cytosine modification encompass bisulfite convertible (non-methylated, non-modified) and non-convertible (methylated, modified) cytosine. Both termini need to be reinterpreted, as described. According to the novel scientific findings (i) non-bisulfite convertible cytosine encompasses 5-methylcytosine (mC) and 5-hydroxymethylcytosine (hmC), and (ii) bisulfite convertible cytosine encompasses 5-formylcytosine (fC), 5-carboxycytosine (cC) as well as non-modified cytosine.

Additionally, earlier inventions are based on (i) the ratio of bisulfite convertible cytosine to whole amount of chromatin (cell-type independent, 100% bisulfite convertible DNA locus) or (ii) on the ratio of bisulfite convertible cytosine (fC, cC, non-modified cytosine) to non-bisulfite convertible cytosine (hmC and mC). These ratios are used to characterize cell type, cell differentiation, cell stage as well as pathological cell stages. Therefore, new techniques will result in novel, more specific ratios and might supplement current cell specific, cell state specific as well as pathological patterns of epigenetic modifications and therefore, define potential novel biomarkers. Novel ratios to be discovered as biomarkers can be defined as:

Biomarker Ratio=$a/b$ $a=\Sigma$(C and/or mC and/or hmC and/or fC and/or cC)
$b=\Sigma$(C and/or mC and/or hmC and/or fC and/or cC),
whereby a and b differs from each other by one to four kinds of modifications. Discovery of novel DNA modifications will certainly broaden this enumeration.

For the purpose of the present application, epigenetic modifications in the DNA sequence is referred to by the terminology of (i) bisulfite convertible cytosine (5-formylcytosine, (fC) and/or 5-carboxycytosine (cC)) and (ii) non-bisulfite convertible cytosine ((including 5-methylcytosine (mC), 5-hydroxymethylcytosine, (hmC)). As both kinds of methylation, mC and hmC are not bisulfite convertible it is not possible to distinguish between these two. Likewise, fC, cC as well as non-modified cytosine are bisulfite convertible and can also not be distinguished from each other as well.

Furthermore, apart from the modifications of DNA also histones undergo posttranslational modifications that alter their interaction with DNA and nuclear proteins. Modifications include methylation, acetylation, phosphorylation, ubiquitination, sumoylation, citrullination, and ADPribosylation. The core of the histones H2A, H2B, and H3 can also be modified. Histone modifications act in diverse biological processes such as gene regulation, DNA repair, chromosome condensation (mitosis) and spermatogenesis (meiosis). Also for these modifications a specific pattern of modification is specific for different cell types, cell stages, differentiation status and such a pattern can be analyzed for bisulfite convertibility or similar methods in order to identify certain cells and cell stages. The present invention also encompasses a use of these modifications.

It is expected that further variants of DNA modifications will be discovered in future. Each type of modification will be either bisulfite-convertible or not. These novel modifications can also be used as biomarker readout. Additionally, it is expected that novel methods for bisulfite modification will be established, resulting in a different set of convertible and non-convertible DNA.

The variety of indications for which reporting of the cellular immune status is clinically or analytically helpful is very large. For almost every disease the cellular immune status is either directly relevant or—such as in cancer—becomes relevant due to the impact of drugs that may cause secondary immunological disorders and aberrations. This broad significance of the overall immune status in diseases settings results in a significant demand for methods to measure these parameters, i.e., the leukocyte subtypes and subpopulations.

The current way of addressing this demand is by flow cytometric and immunohistochemical methods, which are well-established and have been developed into high throughput systems for hospital use, are standard procedures in reference laboratories and are, for more simple applications, made available for practitioners. However, certain problems and requirements limit the applicability of flow cytometry and immunohistochemistry.

a) For flow cytometry, cells need to be intact. This means that the blood sample has to be measured in a "fresh" state, any delay in measurement may lead to deviation of results. As a rule of thumb, samples should be measured within 8 hours, since after that time frame granulocytes (one main cellular fraction in the blood) begin to disintegrate. As an alternative to fresh handling, it is possible to cryopreserve blood samples, but there are significant issues associated with respect to performance and reproducibility. As a consequence, flow cytometry in clinical routine is avoided and many potentially meaningful analyzes are omitted, whereas in clinical trials, where immune markers are prime biomarker candidates for treatment predictions, are often left out, or if required by regulations extra facilities need to be set up.

b) Antigen expression is not a digital (on-off), but an analog (low, medium, high) process. Therefore, thresholds defining positive versus negative signals must be determined. For certain markers, this is unproblematic, for others thresholds are very difficult and imprecise.

c) For flow cytometry, it also poses problems that many cell types are not simply identified by a surface (cluster of differentiation—CD) molecule, but some cell types are characterized by intra- or extracellular soluble proteins, e.g. transcription factors or cytokines. Current markers for Tfh, Th1, Th2 cells, and Tregs belong to this category of cell types—the application of fully standardized procedures is even more difficult. This is because the cell-type specific markers need to be captured in order to be associated to the cell.

d) Furthermore, flow cytometry is dependent on the solubility of the analyzed substrate (cell suspensions). With respect to this, tissue cells may be solubilized by enzymatic digestion, but this often leads to the loss of their surface molecules—rendering the CD markers, as prime targets for flow cytometric analysis useless.

e) Often, neither surface- nor intra- or extracellular markers are 100% cell-type specific. "Leaky" expression of certain gene products has been reported (Wiezcorek et al., Cancer Res. 2009 Jan. 15; 69(2):599-608), rendering the quantification somewhat imprecise.

f) Since immunohistochemistry is based on the same principle as flow cytometry, specificity problems overlap. However, the main problem with this technology is that it is considered only semiquantitative. In particular, a particular problem is that an overall cell counting is not feasible due to the presence of various different cell layers, which are difficult to distinguish and count correctly.

As far as aspect e) is concerned, the inventors have previously published a publication proving that flow cytometry detects expressed surface epitopes, but it cannot distinguish between cell-type specific epitope expression and cell-type independent induction of epitope expressions as well as it cannot detect specific-cells that currently not express or less express certain surface markers. In vitro stimulation of $CD4^+CD25^+CD45RA^+$ T cells, for example, leads to a high expression level of FOXP3 whereby the FOXP3 gene is still methylated and therefore inactivated (Baron et al., Epigenetics. 2006 January-March; 1(1):55-60). Additionally, for in vitro differentiated Th17 cells no demethylation of IL-17A promotor was observed despite high levels of IL-17A transcripts (Janson P. C. J. et al. Profiling of CD4+ T cells with epigenetic immune lineage analysis. The Journal of Immunology. 2010, 92-102). On the other side it is disclosed that methylation is connected with marker expression (Hamerman, Page, Pullen. Distinct methylation states of the CD8β gene in peripheral T cells and Intraepithelial Lymphocytes. The Journal of Immunology 1997, P1240-1246; Janson P. C. J. et al. Profiling of CD4+ T cells with epigenetic immune lineage analysis. The Journal of Immunology. 2010. 92-102; Melvin et al. Hypomethylation in IFN-Gamma Gen correlates with expression of IFN-G, including CD8 cells., Eur J Immunol. 1995 February; 25(2):426-30; Landolfi M M et al. $CD2^-CD4^-CD8^-$ lymph node T lymphocytes in MRL lpr/lpr mice are derived from a $CD2^+CD4^+CD8^+$ thymic precursor J Immunol. 1993 Jul. 15; 151(2):1086-96; and Carbone A M et al. Demethylation in CD8 suggests that CD4+ derives from $CD8^+$ cells. Role of methylation pattern during cell development. Science. 1988 Nov. 25; 242(4882):1174-6).

In view of the above mentioned demands in both clinical diagnostics and pharmaceutical research, a new method to provide a precise and comprehensive quantification of a variety of cell types in a sample is desired, in order to establish a more precise and thus markedly improved haemogram. Further objects and advantages will become apparent to the person of skill upon reading the present disclosure, and particularly the examples below.

In a first aspect thereof, this object is solved by the present invention by a method for producing an epigenetic haemogram, comprising the steps of epigenetically detecting blood cells in a biological sample, and quantifying said blood cells as detected using a normalization standard, wherein said normalization standard is a nucleic acid molecule comprising at least one marker-region being specific for each of the blood cells to be detected, and at least one control-region being cell-unspecific, wherein said regions are present in the same number of copies on said molecule and/or a natural blood cell sample of known composition.

Key and basis of the present invention is the use of a variety of different cell-type specific bisulfite-convertible DNA marker. These markers are employed for the identification and quantification of a single blood and immune cell types.

In principle, it was previously shown how a quantification of cell types and blood cell counting based on known epigenetic procedures is performed ((Wiezcorek et al., Cancer Res. 2009 Jan. 15; 69(2):599-608, Sehouli et al. Epigenetics. 2011 February; 6(2):236-46.). In brief, either a cell type specifically modified gene region is specifically (amplified and) counted and hence quantitated along with the opposite species of the cell type specific gene region. To provide for an independent quantification, these two measurements are then put into relation to provide the percentile part of the cell type in the given (blood) sample:

> Copy number of bisulfite convertible DNA of cell-type specific genomic region/(copy number of bisulfite convertible DNA of cell-type specific genomic region)+(Copy number of non-bisulfite convertible DNA of cell-type specific genomic region)=% cell type Alternatively, the number of copies of bisulfite convertible DNA of a cell-type specific gene region is measured and divided by the copy number of bisulfite-convertible DNA of a cell-type non-specific gene region in the given sample. The latter can be determined by measuring all DNA copies using a completely bisulfite-convertible, cell-unspecific gene region or a region that is known to be uniformly bisulfite-unconvertible or bisulfite-convertible in all cell types.

> Copy number of bisulfite convertible DNA of cell-type specific genomic region/Copy number of a bisulfite convertible DNA of cell-type unspecific genomic region=% cell type Hence, when a single specific bisulfite-convertible genomic marker is known, the previously established system allows the relative (percentile (%)) quantification of any one cell type in a given sample. For this, any given standardization of copy numbers or copy equivalents can be used. The resulting percentile share of the cell type in question correlates with the share of cells measured with a different method. Here, "correlating" means that—according to Spearman correlation—the lowest share measured by the epigenetic technology corresponds to the lowest share measured by—for example—flow cytometry. Such system has been shown to be very stable, technically robust and reliable. Therefore, whenever there is a highly cell-specific bisulfite convertible DNA marker achieved, in theory it should be possible to make an accurate and precise determination of the amount of those cells that own the specific bisulfite convertible genomic marker region.

It is known that the efficiency and performance of Real time (RT-)PCR systems differ depending on the RT-PCR components, including primers, probes, and the purity of DNA. Therefore, standards are employed in order to account for the problem to know at which Cp (crossing point) or Ct (threshold cycle) value a given (known) amount of standard DNA can be detected. A dilution series of said standard DNA gives a standard curve, and allows for the normalization of differently performing/efficient RT-PCR systems. Since the quantification is performed on an equivalent system, differences in performance are normalized. However, the problem addressed concerns an (RT-)PCR that is performed on DNA aiming at the detection of biologically and/or chemically altered DNA. The complexity of this biologically and/or chemically altered DNA differs from normal/natural genomic DNA (starting by the simple fact that the complexity of the DNA molecules differ, since a plasmid consists of double stranded DNA of four bases (CTGA), whereas genomic DNA consists of double stranded five bases ($CTGAC^m$), and bisulfite converted DNA merely consists of only three single stranded bases (TGA)). Thus, the efficiency of amplification differs between the target DNA (i.e., human chromosomal genomic or bisulfite-converted DNA) and the standard DNA, if the standard is a plasmid or genomic DNA, but more importantly, the "amplification efficiency difference" between (plasmid) standard and the target DNA differs from amplification target to amplification target. (i.e., primer pair, probe etc.). This leads to a number of observations, when qPCR is performed on bisulfite treated and amplified DNA, such as, for example:

When different blood cells in a sample shall be measured, independently of method as used, the total cell number should be equivalent. However, in a given sample that is equally distributed for the performance of different qPCR-assays, despite the use of individual standards for each reaction the total number of copies as detected is different. This leads to the following problem (here shown with CD3 as an example) in case of (e.g.) blood samples that are measured using different RT-PCR systems:

TABLE 1

Calculation of overall DNA copy numbers and quantitative cell content following epigenetic qPCR using bisulfite-treated, amplified DNA of a blood sample. (CP) crossing point, (CN – BC) copy numbers bisulfite converted $CD3^+$ marker DNA region, (CN – NBC) copy numbers non-bisulfite converted $CD3^+$ marker DNA region, (CN – GAPDH) copy numbers bisulfite converted GAPDH marker DNA region.

| | PCR for $CD3^+$ bisulfite converted DNA | | | | PCR for $CD3^+$ non-bisulfite converted DNA | | |
|---|---|---|---|---|---|---|---|
| sample ID | CP | copy numbers acc. to plasmid standard | mean copy numbers (CN – BC) | sample ID | CP | copy numbers acc. to plasmid standard | mean copy numbers (CN – NBC) |
| WBL02 | 31.81 | 114.00 | 264.67 | WBL02 | 27.01 | 1410.00 | 1413.33 |
| WBL02 | 30.31 | 323.00 | | WBL02 | 26.99 | 1430.00 | |
| WBL02 | 30.17 | 357.00 | | WBL02 | 27.03 | 1400.00 | |
| WBL03 | 29.21 | 692.00 | 693.00 | WBL03 | 27.46 | 1070.00 | 1053.33 |
| WBL03 | 29.3 | 650.00 | | WBL03 | 27.53 | 1020.00 | |
| WBL03 | 29.12 | 737.00 | | WBL03 | 27.45 | 1070.00 | |

| | | | | PCR for GAPDH bisulfite converted DNA | | | |
|---|---|---|---|---|---|---|---|
| | Calculation overall DNA copy numbers | | | sample | | copy numbers acc. to plasmid | mean copy numbers |
| sample | CN – BC + CN – NBC | CN – GAPDH | | ID | CP | standard | (CN – GAPDH) |
| WBL02 | 1678 | 1420 | | WBL02 | 27.3 | 1520.00 | 1420.00 |
| WBL03 | 1746.33 | 1383.33 | | WBL02 | 27.48 | 1350.00 | |
| | | | | WBL02 | 27.44 | 1390.00 | |
| | | | | WBL03 | 27.47 | 1360.00 | 1383.33 |
| | | | | WBL03 | 27.43 | 1390.00 | |
| | | | | WBL03 | 27.42 | 1400.00 | |

| | Calculation of % $CD3^+$ cell content | |
|---|---|---|
| sample | $\dfrac{CN - BC \times 100}{(CN-BC+CN-NBC)}$ | $\dfrac{CN - BC \times 100}{CN-GAPDH}$ |
| WBL02 | 15.8% | 18% |
| WBL03 | 36.6% | 50.1% |

As indicated in Table 1, calculated overall CD3+ DNA copy numbers differ between the two used standardization systems: bisulfite-converted vs. non-converted DNA and bisulfite-converted CD3+ marker region to bisulfite-converted GAPDH (overall cell) marker region. For the first blood sample (WBL02), number of CD3+ DNA copies calculated via number of GAPDH bisulfite converted DNA (1420 copies) is smaller than calculated via bisulfite converted added to non-bisulfite converted CD3+ DNA copy numbers (1678 copies). For the second sample (WBL03) the situation is similar. Differences become more obvious when using these calculated copy numbers for quantification of CD3+ cells within these two blood samples. For sample WBL02, quantification via bisulfite converted to non-converted DNA copy numbers results in 36.6% CD3+ cells, whereas quantification via bisulfite converted CD3+ DNA copy numbers to bisulfite converted GAPDH DNA copy numbers results in 50.1% CD3+ cells. Both results and methods differ strongly.

As mentioned, even if normalization on a bisulfite-converted plasmid standard is performed, the different performances/efficiencies of the different assays do not lead to the same copy number.

This problem becomes particularly apparent, when purified cell types are measured with "their" specific epigenetic cell type markers, and compared to the total amount of cells in the sample (as measured by an cell-type unspecific marker (GAPDH)) as well as measured by non-bisulfite convertible DNA of a cell-type specific marker region (here FOXP3).

TABLE 2

Assessment of quantitative amount of regulatory T cell (Treg) within two samples of purified Tregs. DNA was isolated, bisulfite treated and relative amount of bisulfite converted and non-converted DNA assessed via qPCR. Copy numbers of bisulfite converted DNA in cell-specific FOXP3 regions were set in relation to copy numbers of bisulfite converted DNA in cell-unspecific GAPDH region as well as to bisulfite non-converted DNA in cell-type specific FOXP3 regions to obtain quantitative number of Tregs. (CP) crossing point, (CN-BC) copy numbers bisulfite converted cell-type specific FOXP3 DNA region, (CN-NBC) copy numbers non-bisulfite converted cell-type specific FOXP3 DNA region (CN-GAPDH) copy numbers bisulfite converted GAPDH DNA region.

PCR for FOXP3 bisulfite converted DNA

| sample ID | CP | mean copy numbers acc. to plasmid standard (CN-BC) |
|---|---|---|
| 88 | 27.52 | 2366.6 |
| 95 | 29.73 | 513.34 |

PCR for FOXP3 non-bisulfite converted DNA

| sample ID | CP | mean copy numbers acc. to plasmid standard (CN-NBC) |
|---|---|---|
| 88 | 32.82 | 72.54 |
| 95 | 35.48 | 10.92 |

PCR for GAPDH bisulfite converted DNA

| sample ID | CP | mean copy numbers acc. to plasmid standard (CN-GAPDH) |
|---|---|---|
| 88 | 26.6 | 2320.00 |
| 95 | 28.91 | 483.67 |

TABLE 2-continued

Assessment of quantitative amount of regulatory T cell (Treg) within two samples of purified Tregs. DNA was isolated, bisulfite treated and relative amount of bisulfite converted and non-converted DNA assessed via qPCR. Copy numbers of bisulfite converted DNA in cell-specific FOXP3 regions were set in relation to copy numbers of bisulfite converted DNA in cell-unspecific GAPDH region as well as to bisulfite non-converted DNA in cell-type specific FOXP3 regions to obtain quantitative number of Tregs. (CP) crossing point, (CN-BC) copy numbers bisulfite converted cell-type specific FOXP3 DNA region, (CN-NBC) copy numbers non-bisulfite converted cell-type specific FOXP3 DNA region (CN-GAPDH) copy numbers bisulfite converted GAPDH DNA region.

Calculation of % Treg cell content

| sample ID | $\frac{\text{CN-BC} \times 100}{(\text{CN-BC} + \text{CN-NBC})}$ | $\frac{\text{CN-BC} \times 100}{\text{CN-GAPDH}}$ |
|---|---|---|
| 88 | 97.03% | 102% |
| 95 | 97.92% | 106% |

As can be seen from table 2, again, results for both of the quantification methods differ strongly (97% vs. 102% and 97% vs. 106%).

Finally, when different cell fractions, e.g. blood leukocytes, are measured that, when added up, should make up all cells in the sample as present, the above problem makes it impossible to provide for a correct "complete blood count". As an example for this, for two blood samples the leukocytes were quantified (Table 3, sample 04 and sample 08). Here, the term leukocytes summarize all the five types of white blood cells: granulocytes, monocytes, B-lymphocytes, natural killer cells, and CD3+ T-lymphocytes. Accordingly, it was expected that the single cell counts sum up to 100%, representing a (complete) leukocytogram. However, when using epigenetic qPCR analyses, this is often not the case (see Table 3). The sum of individual quantities of leukocytes often differs from 100%.

TABLE 3

Assessment of the quantitative cell composition of two blood samples. DNA was isolated, bisulfite treated and relative amount of bisulfite converted DNA assessed via qPCR. Copy numbers of bisulfite converted DNA in cell-specific regions were set in relation to bisulfite converted copy numbers of the cell-unspecific DNA region for GAPDH to obtain quantitative number of leukocytes. (CN-BC) copy numbers bisulfite converted cell-type specific marker DNA region, (CN-GAPDH) copy numbers bisulfite converted GAPDH marker DNA region.

Calculation of Leukocytogram (% of cells)

| cell type | sample04 $\frac{\text{CN-BC} \times 100}{\text{CN-GAPDH}}$ | sample08 $\frac{\text{CN-BC} \times 100}{\text{CN-GAPDH}}$ |
|---|---|---|
| granulozytes | 79.74% | 81.29% |
| monozytes | 7.94% | 11.05% |
| B cells | 1.63% | 1.68% |
| natural killer cells | 2.74% | 2.04% |
| T cells | 23.25% | 22.09% |
| Sum: | 115.3 | 118.15 |

When summarizing the above mentioned problems of epigenetic cell quantification, a precise blood counting tool provides the following:
1. allows for the assessment of a precise, comprehensive blood and immune cell count,
2. overcomes differences in assay performance and/or efficiency between standards as used and the biological sample to be analyzed,
3. is independent of membrane integrity of cells to be counted (intact or non-intact cells), and 4. is independent of type of cell containing sample (fresh, frozen, embedded, stored, fluids, solid tissues).

The present invention provides such a tool, and respective methods. According to the present invention, assessing the epigenetic haemogram comprises measurement of the absolute amount of cells by normalization of qPCR results on a bisulfite-unconverted or -converted normalization standard. The normalization standards consist of a nucleic acid molecule comprising at least one marker-region being specific for each of the blood cells to be detected, and at least one control-region being cell-unspecific, wherein said regions are present in the same number of copies on said molecule and/or a natural blood cell sample of known composition.

In a first step of a preferred embodiment of the method, qPCR assay-specific correction factors are determined to achieve normalization and comparability of all qPCR assays as well as to correct for differences in assay efficiencies. In a second step, DNA of biological sample is isolated, purified and bisulfite treated. This is followed by qPCR specific for bisulfite-converted cell-type specific and/or cell-type unspecific genomic marker regions. The qPCR amplification results are then normalized with said normalization standard, which represents the relative amount of copies of marker DNA, and therefore the relative amount of specific cells. The normalization standard contains bisulfite-converted genomic marker regions or contains native, bisulfite-unconverted, marker regions. Before starting the qPCR, in the latter case the nucleic acid will be bisulfite treated in parallel to the biological sample as analyzed is treated. In a next step, following qPCR, the normalized relative amount of copies of marker DNA is corrected by an assay specific correction factor as described herein in order to correct for differences in assay efficiencies indicating the absolute amount of cells.

The present method allows for a quantification of non-intact but also intact blood cells in biological samples, such as, for example, dried, frozen, embedded, stored as well as fresh body fluids, dried blood spots, blood clots and tissue samples. The sample does not contain purified or enriched cells. Furthermore, the method of the present invention provides for a blood count, wherein the identity and quantity of cells is based on a clear yes/no information on the genomic level that is independent from protein expression levels.

The present invention thus provides a blood and/or immune cell count to be used as an analytical and diagnostic tool for medical use and as a basis for decisions in therapy.

Preferred is a method according to the present invention, furthermore comprising the step of obtaining a comprehensive blood picture, based on said detecting and quantifying. The blood cell count thus identifies the comprehensive picture of the cellular composition based on a number of epigenetic parameters. The combination of these epigenetic parameters is used to identify the cell composition of a blood or tissue sample, i.e. an epigenetic haemogram, and said epigenetic haemogram is provided based on the analysis of the bisulfite convertibility of cell-specific genomic regions.

Preferably, said epigenetic haemogram resembles a leukocytogram and/or a T-lymphocytogram and/or a granulocytogram and/or a monocytogram and/or a B-lymphocytogram and/or a NK cytogram.

Preferably, the method according to the present invention furthermore comprises the use of a bisulfite-unconverted or -converted normalization standard for the normalization, e.g. of the qPCR results. The term "bisulfite-unconverted" normalization standard encompasses natural DNA molecules containing the original/primary biologic modifications, such as formylation, carboxylation, methylation, or hydroxymethylation and that is not bisulfite-treated, and therefore bisulfite-unconverted. The term "bisulfite-converted" normalization standard encompasses DNA molecules containing (genomic) marker sequences corresponding to already bisulfite-converted cell-type specific and unspecific marker regions.

The bisulfite-unconverted or bisulfite-converted nucleic acid molecule is preferably selected from a plasmid, a yeast artificial chromosome (YAC), human artificial chromosome (HAC), P1-derived artificial chromosome (PAC), a bacterial artificial chromosome (BAC), and a PCR-product. Bisulfite-converted normalization standard is a plasmid, yeast artificial chromosomes (YAC), human artificial chromosome (HAC), P1-derived artificial chromosome (PAC), bacterial artificial chromosome (BAC) or a PCR-product.

The natural blood cell sample preferably is a blood sample of known cellular composition, and/or of known composition of blood cell types, and is preferably produced in advance, i.e. the amount and number blood cell types as combined is pre-determined.

In a preferred embodiment of the method according to the invention, the normalization standard, i.e. the plasmid, YAC, HAC, PAC, BAC, and PCR-product, contains cell-specific and unspecific genomic marker regions (to be analyzed in accordance with the epigenetic haemogram) in the same known number of copies on said molecule. In one embodiment, each of these standards is a single molecule containing the same number of all cell-type specific and unspecific genomic marker regions of interest in the epigenetic haemogram to be established. The natural blood cell sample (preferably mammalian, such as human) used as the bisulfite-unconverted normalization standard contains cells in a known composition and quantity, whereby cells can be pre-purified and pre-mixed to obtain a sample of known composition, that is also pre-determined.

During analytical processing, the bisulfite-unconverted normalization standard is bisulfite-treated in parallel and in the same fashion than the bisulfite treatment of the biological sample to be analyzed.

Then, qPCR on the unknown biological sample as well as on the (now) bisulfite-treated bisulfite-unconverted normalization standard is performed using specific primers that help to detect cell-type specific or unspecific bisulfite-converted genomic regions. In contrast, the bisulfite-converted normalization standard will (obviously) not be bisulfite-treated, as it already contains specific marker sequences that correspond to bisulfite-converted marker sequences recognized by qPCR primers that are specific for bisulfite-converted genomic regions.

In a preferred embodiment, the normalization standard comprises a predetermined amount of blood cells of the types to be detected and analyzed according to the haemogram. Preferably, a normalization standard is used consisting of a defined copy number and same stoichiometric amount of specific cells and/or of cell-type specific and/or cell-type unspecific marker regions. Preferred is a single plasmid containing the same copy number and/or stoichiometric amount of cell-type specific and/or cell-type unspecific marker regions for all cell types of interest for the haemogram.

A preferred embodiment of the method according to the invention furthermore comprises the step of correcting said epigenetic haemogram as produced with an assay specific correction factor. Said assay-specific correction factor (for the cells as detected and analyzed) is determined by comparing the known quantitative amount of cells in said mammalian natural cell sample as provided with the relative amount of copy numbers of bisulfite-converted cell-type specific marker DNA of said mammalian natural cell sample assessed by the qPCR using the normalization standard. Using this approach, the present method allows for an accurate quantification of cells, as any assay-specific variations that may have occurred are taken into account. Depending from the kind of normalization standard as used, the assay specific correction factors can differ. The more the normalization standard and its analytical processing are adapted to the biological sample and its processing, the more the assay specific correction factors will approach 1, or even can be neglected. In a preferred embodiment, a bisulfite-unconverted normalization standard is used as it resembles the complexity and impureness of natural cell samples, and therefore the qPCR efficiency between a biological sample and standard should be aligned. Most preferred is the use of a mammalian natural cell sample of known cell composition and quantity as described herein.

The method according to the present invention then comprises the step of determining the relative amount (of copies) of cell-type specific and unspecific DNA within the biological sample of unknown composition. This is achieved by qPCR on isolated, purified and bisulfite-converted DNA of said biological sample under the use of primers specific for bisulfite-converted cell-type specific and unspecific DNA marker sequences. qPCR amplification results for all target cell types are the normalized on said bisulfite-unconverted or converted standard indicating the relative amount of target cells. According to standards and assays used, specific assay correction factors are applied on relative amount of target cells to receive the absolute amount and percentage of the content of cells according to said haemogram as established. Thereby, the absolute, comprehensive cellular composition in said biological sample is determined. Depending from the normalization standard used, the assay correction factor differs from 1, or is approximately 1, and then can be neglected. Other methods for determining the relative amount (of copies) of cell-type specific and unspecific DNA comprise a method selected from specific enzymatic digests or dye exclusion technologies, bisulfite sequencing, next generation sequencing, nanopore sequencing, single molecule real-time sequencing, analyses of epigenetic modifications in promoter regions, using primers specific for bisulfite-converted DNA, using blocking oligonucleotides specific for bisulfite-converted DNA, using fluorescence-labeled, quenched oligonucleotide probes, using primers for single nucleotide primer extension specific for bisulfite-converted DNA, digital or quantitative PCR analysis, and specific selective (nucleic acid and/or chromatin) precipitation.

Preferred is a method according to the present invention, wherein the determination of the relative amount of target cells is based on comparing the amounts of copies of said bisulfite-converted cell-specific regions as determined with the amounts of copies of the bisulfite-converted regions that are unspecific for a cell-type as determined, thereby identifying the relative amount of a specific cell type in relation to all cells present in the sample.

In one embodiment according to the present invention, the relative amount of target cells is determined based on comparing the amounts of copies of said bisulfite-converted cell-specific regions as determined with the amounts of copies of bisulfite-unconverted cell-specific regions as determined, thereby identifying the relative amount of target cells in relation all other cells present in the sample.

In a preferred embodiment of the method according to the invention, further a knowledge base comprising information about cell-specific assay-correction factors estimated/calculated during previous assessments of epigenetic assays is generated. These values may be advantageously used in order to select particularly suitable normalization standards.

In a particularly preferred embodiment of the method according to the present invention, cell-type marker regions are detected that discriminate a specific cell type and/or at least one specific subpopulation of cells from other cells of a leukocytogram, a T-lymphocytogram, a granulocytogram, a monocytogram, a B-lymphocytogram and/or a NK-cytogram. Preferably, a) the leukocytogram consists of T-lymphocytes, natural killer cells, B-lymphocytes, monocytes and/or granulocytes, b) the T-lymphocytogram consists of $CD3^+CD4^+$, $CD3^+CD8^+$, $CD8^-CD4^-$, and/or $CD8^+CD4^+$ c) the granulocytogram consists of basophilic, eosinophilic, neutrophilicgranulocytes, and/or granulocytic myeloid-derived suppressor cells, d) the monocytogram consists of $CD14^+$ monocytes, $CD14^-$ monocytes, macrophages, monocytic myeloid-derived suppressor cells, plasmacytoid dendritic cells, myeloid dendritic cells, and/or overall dendritic cells, e) the B-lymphocytogram consists of naïve B cells, pre-B cells, memory B cells, transitional B cells and/or immature B cells, and f) the NK cytogram consists of $CD56^{dim}$ and/or $CD56^{bright}$ NK cells.

Preferably, within the haemogram as determined sub-haemograms (or subpopulations) can be determined. Preferred is a T-helper-cytogram comprising, e.g., Th1, Th2, Th9, Th17, Th19, Th 21, Th22, Tfh, $CD4^+$ natural killer cells (NKT), naïve $CD4^+$, memory $CD4^+$, effector $CD4^+$ cells, and/or $CD4^+$ regulatory T cells, or a T-cytotoxogram comprising, e.g., naïve $CD8^+$, effector $CD8^+$, memory $CD8^+$, $CD8^+$ natural killer cells (NKT), and/or $CD8^+$ regulatory T cells. Furthermore, sub-populations of monocytes can be determined, comprising classical monocytes ($CD14^-$), intermediate monocytes ($CD14^+$) and/or non-classical monocytes ($CD14^{++}$) or a dendritogram comprising myeloid dendritic cells, and plasmacytoid dendritic cells. Future scientific studies may discover and identify yet unknown blood cells and leukocyte subgroups and may will assign new functions to certain blood cells and/or will assign known blood cells to different leukocyte subpopulations.

To determine the relative amount of bisulfite-convertible and/or non-bisulfite convertible DNA or nucleic acid comprises a method selected from specific enzymatic digests or dye exclusion technologies, bisulfite sequencing, next generation sequencing, nanopore sequencing, single molecule realtime sequencing, analyses of epigenetic modifications in promoter regions, using primers specific for bisulfite-converted DNA, using blocking oligonucleotides specific for bisulfite-converted DNA, using fluorescence-labeled, quenched oligonucleotide probes, using primers for single nucleotide primer extension specific for bisulfite-converted DNA, digital or quantitative PCR analysis, and specific selective (nucleic acid and/or chromatin) precipitation.

Further preferred is a method according to the present invention, wherein said normalization standard is bisulfite-unconverted and contains at least one bisulfite-convertible CpG position.

Further preferred is a method according to the present invention, wherein said quantifying of cell types in said biological sample is based on the normalization of the relative amount of cell-type specific and unspecific chromatin using the bisulfite-unconverted normalization standard or using the bisulfite-converted normalization standard.

Even further preferred is a method according to the present invention, wherein said normalization using the bisulfite-unconverted normalization standard is indicative for the absolute amount and/or percentage of content of cells within said biological sample Even further preferred is a method according to the present invention, wherein said biological sample is a sample of unknown cellular composition.

The biological sample as analyzed in the context of the present invention is any sample that contains cells to be analyzed, i.e. cells of the blood and/or immune system, such as cells of a leukocytogram, selected from T-lymphocytes, natural killer cells, B lymphocytes, monocytes, and/or granulocytes, and combinations thereof; a T-lymphocytogram, selected from CD3$^+$CD4$^+$, CD4$^+$ memory, CD4$^+$ effector cells, CD4$^+$ naïve, CD3$^+$CD8$^+$, CD8$^+$ memory, CD8$^+$ effector cells, CD8$^+$ naïve, CD3$^+$CD8$^-$ CD4$^-$, CD3$^+$ CD8$^+$CD4$^+$, NKT cells, iTreg, Treg, Tfh, Th1, Th2, TH9, Th17, Th19, Th21, Th22, memory and/or effector T helper cells, and combinations thereof, a granulocytogram, selected from basophilic, eosinophilic, neutrophilic, overall neutrophil granulocytes, and/or granulocytic myeloid-derived suppressor cells, and combinations thereof, a monocytogram, selected from CD14$^+$ monocytes, CD14- monocyes, macrophages, plasmacytoid dendritic cells, monocytic myeloid-derived suppressor cells, intermediate monocyets, classical monocytes, non-classical monocytes, and/or overall dendritic cells, and combinations thereof, a B-lymphocytogram, selected from naïve B cells, pre B cells, memory B cells, transitional B cells and/or immature B cells, and combinations thereof, and a NK cytogram, selected from CD56$^{dim}$ and/or CD56$^{bright}$ NK cells.

The term "cell-specific region(s)" herein shall mean genetic regions in the genome of cells and/or nucleic acids that are selected to discriminate on an epigenetic level one cell type and/or subpopulations of cells from all other cell types and/or subpopulations of cells. These regions include the genes of certain markers (such as, for example, certain protein markers), such as 5' untranslated regions, promoter regions, introns, exons, intron/exon borders, 3' regions, CpG islands, and in particular include specific regions as amplified after bisulfite treatment (amplicons) that are "informative" about the one cell type and/or subpopulations of cells. Examples for these cell-specific regions are known from the literature, such as, for example, the gene CD3 γ, δ and ε (WO 2010/069499); the granulysine gene (WO 2010/125106); the CCR6 gene (WO 2011/135088); the FOXP3 gene (WO 2004/050706 and Wieczorek et al. Quantitative DNA methylation analysis of FOXP3 as a new method for counting regulatory T cells in peripheral blood and solid tissue. Cancer Res. 2009 Jan. 15; 69(2):599-608.)

Cell-specific marker region usually are DNA regions that contain single CpGs or CpG islands that are bisulfite-convertible only in a specific cell type and therefore indicative for the specific cell type. Additionally, these cell-specific marker regions discriminate one cell type from all other blood cells as well as other tissue cells.

According to the present invention, cells of the epigenetic haemogram are identified and quantified by analyzing the bisulfite convertibility of at least on CpG position in said cell-specific genomic regions.

Thus, preferred is a method according to the present invention, wherein a bisulfite conversion of at least one CpG position within a region as listed in the following table 4 is indicative for the respective blood cell type as listed in said table. These are e.g. the following genomic marker regions for the given cell types:

TABLE 4 cell-specific genomic regions

| Pos | Marker-ID | TargetID | SYMBOL | Accession | ENSEMBL (ENSG #) | Granulocytes | Monocytes | CD4+ cells | cytotoxic T-cells | B-cells | NK-cells | NK T's | SEQ ID Discovery fragment/ SEQ ID ROI |
|---|---|---|---|---|---|---|---|---|---|---|---|---|---|
| 1 | NK_nm1 | cg08766149 | GZMB | NM_004131 | 00100453 | 0.91 | 0.90 | 0.87 | 0.89 | 0.57 | 0.13 | | 1/2 |
| 2 | NK_nm2 | cg22917487 | CX3CR1 | NM_001337 | 00168329 | 0.92 | 0.92 | 0.94 | 0.92 | 0.57 | 0.13 | | 3/4 |
| 3 | NK_nm3 | cg12445208 | ZNF583 | NM_152478 | 00198440 | 0.77 | 0.83 | 0.76 | 0.64 | 0.73 | 0.18 | 0.54 | 5/6 |
| 4 | NK_nm4 | cg02196805 | CSF2 | NM_000758 | 00164400 | 0.78 | 0.78 | 0.50 | 0.60 | 0.77 | 0.22 | 0.52 | 7/8 |
| 5 | NK_nm5 | cg23617121 | OSBPL5 | NT_009237 | 00021762 | 0.95 | 0.95 | 0.92 | 0.89 | 0.85 | 0.22 | 0.81 | 9/10 |
| 6 | NK_nm6 | cg20697204 | FLJ40172 | NM_173649 | 00239605 | 0.78 | 0.89 | 0.91 | 0.83 | 0.73 | 0.23 | | 11/12 |
| 7 | NK_nm7 | cg11801011 | SHANK1 | NM_016148 | 00161681 | 0.68 | 0.62 | 0.64 | 0.72 | 0.56 | 0.26 | | 13/14 |
| 8 | NK_nm8 | cg07873128 | OSBPL5 | NT_009237 | 00021762 | 0.93 | 0.94 | 0.93 | 0.93 | 0.60 | 0.27 | | 15/16 |
| 9 | NK_nm9 | cg03368758 | LDB2 | NM_001290 | 00169744 | 0.74 | 0.78 | 0.75 | 0.71 | 0.67 | 0.27 | 0.68 | 17/18 |
| 10 | NK_nm10 | cg00515905 | EPS8L3 | NM_024526 | 00198758 | 0.92 | 0.93 | 0.92 | 0.94 | 0.84 | 0.29 | | 19/20 |
| 11 | NK_nm11 | cg22228134 | GZMH | NM_033423 | 00100450 | 0.83 | 0.90 | 0.90 | 0.89 | 0.53 | 0.30 | | 21/22 |
| 12 | NK_nm12 | cg26379475 | SH2D1B | NM_053282 | 00198574 | 0.79 | 0.79 | 0.64 | 0.64 | 0.59 | 0.32 | 0.61 | 23/24 |
| 13 | NK_nm13 | cg04384208 | FCGR3A | NM_000569 | 00203747 | 0.84 | 0.87 | 0.82 | 0.83 | 0.71 | 0.32 | | 25/26 |
| 14 | NK_nm14 | cg00453258 | FAM26C | NM_001001412 | 00185933 | 0.71 | 0.71 | 0.85 | 0.82 | 0.92 | 0.33 | | 27/28 |
| 15 | NK_nm15 | cg06827976 | FGR | NM_005248 | 00000938 | 0.78 | 0.83 | 0.88 | 0.80 | 0.78 | 0.35 | 0.60 | 29/30 |
| 16 | NK_nm16 | cg12491710 | LIM2 | NM_030657 | 00105370 | 0.95 | 0.94 | 0.93 | 0.93 | 0.86 | 0.36 | | 31/32 |
| 17 | NK_nm17 | cg18250832 | NMUR1 | NM_006056 | 00171596 | 0.76 | 0.72 | 0.78 | 0.74 | 0.77 | 0.38 | | 33/34 |
| 18 | NK_nm18 | cg15544721 | PPP1R9A | XM_371933 | 00158528 | 0.64 | 0.76 | 0.85 | 0.88 | 0.53 | 0.38 | | 35/36 |
| 19 | NK_nm19 | cg25943702 | BRD1 | NM_014577 | 00100425 | 0.80 | 0.84 | 0.80 | 0.78 | 0.73 | 0.38 | 0.71 | 37/38 |
| 20 | NK_nm20 | cg04230060 | SUSD1 | NM_022486 | 00106868 | 0.69 | 0.69 | 0.91 | 0.87 | 0.71 | 0.39 | 0.84 | 39/40 |
| 21 | NK_nm21 | cg06229674 | ARP10 | NM_181773 | 00100298 | 0.94 | 0.95 | 0.93 | 0.92 | 0.50 | 0.40 | | 41/42 |
| 22 | NK_nm22 | cg14701962 | C1orf111 | NM_182581 | 00171722 | 0.81 | 0.85 | 0.79 | 0.77 | 0.74 | 0.41 | 0.69 | 43/44 |
| 23 | NK_nm23 | cg16522484 | C14orf49 | NM_152592 | 00176438 | 0.72 | 0.80 | 0.74 | 0.74 | 0.53 | 0.42 | | 45/46 |
| 24 | NK_nm24 | cg26738080 | TNNC1 | NM_003280 | 00114854 | 0.84 | 0.76 | 0.87 | 0.86 | 0.66 | 0.42 | | 47/48 |

TABLE 4-continued cell-specific genomic regions

| Pos | Marker-ID | TargetID | SYMBOL | Accession | ENSEMBL (ENSG #) | Granulocytes | Monocytes | CD4+ T-cells | cytotoxic T-cells | B-cells | NK-cells | NK T's | SEQ ID Discovery fragment/ SEQ ID ROI |
|---|---|---|---|---|---|---|---|---|---|---|---|---|---|
| 25 | NK_nm25 | cg13525683 | TIAF1 | NM_004740 | 00221995 | 0.81 | 0.83 | 0.78 | 0.77 | 0.75 | 0.42 | 0.75 | 49/50 |
| 26 | NK_nm26 | cg23352030 | PRIC285 | NM_033405 | 00130589 | 0.85 | 0.82 | 0.95 | 0.94 | 0.90 | 0.43 | | 51/52 |
| 27 | NK_nm27 | cg23282949 | RENBP | NM_002910 | 00102032 | 0.72 | 0.76 | 0.91 | 0.85 | 0.86 | 044 | 0.81 | 53/54 |
| 28 | NK_nm28 | cg00491404 | EPS8L3 | NM_024526 | 00198758 | 0.88 | 0.83 | 0.88 | 0.87 | 0.79 | 0.45 | | 55/56 |
| 29 | NK_nm29 | cg25903122 | MGC2747 | NM_024104 | 00214046 | 0.87 | 0.92 | 0.92 | 0.89 | 0.68 | 0.48 | | 57/58 |
| 30 | NK_nm30 | cg22202141 | FCGR3A | NM_000569 | 00203747 | 0.90 | 0.87 | 0.88 | 0.89 | 0.58 | 0.48 | | 59/60 |
| 31 | NK_nm31 | cg11094938 | ATP2A1 | NM_173201 | 00196296 | 0.91 | 0.85 | 0.90 | 0.90 | 0.92 | 0.49 | | 61/62 |
| 32 | NK_nm32 | cg23580000 | ADCY7 | NM_001114 | 00121281 | 0.80 | 0.81 | 0.96 | 0.94 | 0.92 | 0.49 | | 63/64 |
| 33 | NK_m1 | cg12167564 | LYST | NM_000081 | 00143669 | 0.30 | 0.13 | 0.47 | 0.50 | 0.36 | 0.68 | 0.37 | 65/66 |
| 34 | NK_m2 | cg18881723 | SLAMF1 | NM_003037 | 00117090 | 0.03 | 0.03 | 0.03 | 0.05 | 0.08 | 0.66 | | 67/68 |
| 35 | NK_m3 | cg18096388 | PDCD1 | NM_005018 | 00188389 | 0.41 | 0.50 | 0.11 | 0.20 | 0.36 | 0.65 | 0.25 | 69/70 |
| 36 | NK_m5 | cg27016307 | HRC | NM_002152 | 00130534 | 0.46 | 0.44 | 0.21 | 0.33 | 0.30 | 0.56 | 0.11 | 71/72 |
| 37 | NK_m6 | cg18818531 | FOSL1 | NM_005438 | 00175592 | 0.40 | 0.42 | 0.17 | 0.17 | 0.37 | 0.56 | 0.25 | 73/74 |
| 38 | NK_m7 | cg27067618 | CYP4F3 | NM_000896 | 00186529 | 0.15 | 0.29 | 0.38 | 0.41 | 0.40 | 0.55 | 0.23 | 75/76 |
| 39 | NK_m8 | cg04790129 | ITGB2 | NM_000211 | 00160255 | 0.13 | 0.24 | 0.35 | 0.40 | 0.13 | 0.54 | 0.39 | 77/78 |
| 40 | NK_m9 | cg25944100 | MS4A3 | NM_006138 | 00149516 | 0.10 | 0.20 | 0.46 | 0.41 | 0.40 | 0.54 | 0.38 | 79/80 |
| 41 | NK_m10 | cg09076123 | NCF2 | NM_000433 | 00116701 | 0.03 | 0.07 | 0.28 | 0.31 | 0.24 | 0.53 | 0.13 | 81/82 |
| 42 | NK_m11 | cg05275752 | GALM | NM_138801 | 00143891 | 0.19 | 0.18 | 0.29 | 0.44 | 0.30 | 0.52 | 0.33 | 83/84 |
| 43 | NK_m12 | cg19030554 | NME3 | NM_002513 | 00103024 | 0.15 | 0.36 | 0.29 | 0.34 | 0.49 | 0.51 | | 85/86 |
| 44 | NKT_n1 | cg02833725 | ISG20L2 | NM_030980 | 00143319 | 0.81 | 0.86 | 0.52 | 0.55 | 0.63 | 0.88 | 0.15 | 87/88 |
| 45 | NKT_n2 | cg06736444 | SRRM2 | NM_016333 | 00167978 | 0.84 | 0.87 | 0.59 | 0.59 | 0.53 | 0.86 | 0.25 | 89/90 |
| 46 | NKT_n3 | cg14862827 | SUSD1 | NM_022486 | 00106868 | 0.62 | 0.62 | 0.59 | 0.71 | 0.55 | 0.65 | 0.17 | 91/92 |
| 47 | NKT_n4 | cg06154597 | MGC4618 | NM_032326 | 00127419 | 0.82 | 0.84 | 0.61 | 0.58 | 0.83 | 0.62 | 0.27 | 93/94 |
| 48 | NKT_n5 | cg17267907 | DEFA1 | NM_004084 | 00239839 | 0.80 | 0.83 | 0.71 | 0.54 | 0.77 | 0.56 | 0.32 | 95/96 |
| 49 | NKT_n6 | cg15210427 | CST9L | NM_080610 | 00101435 | 0.82 | 0.88 | 0.56 | 0.63 | 0.62 | 0.79 | 0.34 | 97/98 |
| 50 | NKT_n7 | cg08603768 | WNT8A | NM_031933 | 00061492 | 0.81 | 0.81 | 0.54 | 0.51 | 0.59 | 0.66 | 0.28 | 99/100 |
| 51 | NKT_n8 | cg14366490 | TXNL6 | NM_138454 | 00171773 | 0.81 | 0.81 | 0.51 | 0.56 | 0.58 | 0.74 | 0.30 | 101/102 |
| 52 | NKT_n9 | cg25827666 | NTRK1 | NM_001007792 | 00198400 | 0.86 | 0.86 | 0.63 | 0.64 | 0.82 | 0.57 | 0.36 | 103/104 |
| 53 | NKT_n10 | cg10624445 | CNGB1 | NM_001297 | 00070729 | 0.83 | 0.86 | 0.58 | 0.58 | 0.64 | 0.82 | 0.35 | 105/106 |
| 54 | NKT_n11 | cg01605984 | SURF5 | NM_181491 | 00148297 | 0.77 | 0.86 | 0.51 | 0.55 | 0.62 | 0.81 | 0.32 | 107/108 |
| 55 | NKT_n12 | cg20661303 | LEFTY2 | NM_003240 | 00143768 | 0.74 | 0.75 | 0.59 | 0.65 | 0.77 | 0.86 | 0.39 | 109/110 |
| 56 | NKT_n13 | cg12240237 | WBSCR23 | NM_025042 | 00006704 | 0.84 | 0.86 | 0.51 | 0.53 | 0.60 | 0.77 | 0.36 | 111/112 |
| 57 | NKT_n14 | cg14375111 | TMEM43 | NM_024334 | 00170876 | 0.92 | 0.95 | 0.62 | 0.61 | 0.65 | 0.89 | 0.45 | 113/114 |
| 58 | NKT_n15 | cg19464252 | FBS1 | NM_022452 | 00156860 | 0.86 | 0.90 | 0.62 | 0.54 | 0.55 | 0.83 | 0.40 | 115/116 |
| 59 | NKT_n16 | cg14076161 | PRB4 | NM_002723 | 00230657 | 0.82 | 0.78 | 0.52 | 0.53 | 0.64 | 0.76 | 0.36 | 117/118 |
| 60 | NKT_n17 | cg10848367 | SCGB1D2 | NM_006551 | 00124935 | 0.78 | 0.78 | 0.55 | 0.60 | 0.56 | 0.68 | 0.34 | 119/120 |
| 61 | NKT_n18 | cg00626119 | NTRK1 | NM_001007792 | 00198400 | 0.79 | 0.82 | 0.59 | 0.61 | 0.80 | 0.57 | 0.38 | 121/122 |
| 62 | NKT_n19 | cg13881341 | FUT1 | NM_000148 | 00174951 | 0.88 | 0.86 | 0.65 | 0.67 | 0.69 | 0.80 | 0.45 | 123/124 |
| 63 | NKT_n20 | cg10779183 | ELA3A | NM_005747 | 00142789 | 0.84 | 0.85 | 0.58 | 0.64 | 0.70 | 0.72 | 0.42 | 125/126 |
| 64 | NKT_m13 | cg00754253 | HRASLS5 | NM_054108 | 00168004 | 0.09 | 0.37 | 0.33 | 0.40 | 0.44 | 0.50 | 0.70 | 127/128 |
| 65 | NKT_m12 | cg13492227 | FGF11 | NM_004112 | 00161958 | 0.17 | 0.20 | 0.50 | 0.45 | 0.31 | 0.38 | 0.69 | 129/130 |
| 66 | NKT_m1 | cg07233761 | ESM1 | NM_007036 | 00164283 | 0.09 | 0.08 | 0.37 | 0.38 | 0.05 | 0.16 | 0.68 | 131/132 |
| 67 | NKT_m2 | cg03973663 | LYN | NM_002350 | 00254087 | 0.12 | 0.11 | 0.39 | 0.42 | 0.24 | 0.14 | 0.66 | 133/134 |
| 68 | NKT_m6 | cg09082287 | DNAJC6 | NM_014787 | 00116675 | 0.15 | 0.15 | 0.41 | 0.35 | 0.30 | 0.24 | 0.66 | 135/136 |
| 69 | NKT_m7 | cg14289511 | FLJ45256 | NM_207448 | 00224310 | 0.09 | 0.10 | 0.45 | 0.40 | 0.23 | 0.12 | 0.62 | 137/138 |
| 70 | NKT_m8 | cg03682712 | LOXL1 | NM_005576 | 00129038 | 0.04 | 0.12 | 0.47 | 0.46 | 0.23 | 0.10 | 0.62 | 139/140 |
| 71 | NKT_m3 | cg16907566 | COL14A1 | NM_021110 | 00187955 | 0.14 | 0.14 | 0.28 | 0.35 | 0.19 | 0.13 | 0.62 | 141/142 |
| 72 | NKT_m5 | cg22854223 | CD82 | NM_002231 | 00085117 | 0.04 | 0.04 | 0.42 | 0.43 | 0.13 | 0.19 | 0.61 | 143/144 |
| 73 | NKT_m15 | cg01305421 | IGF1 | NM_000618 | 00017427 | 0.07 | 0.06 | 0.42 | 0.47 | 0.24 | 0.36 | 0.61 | 145/146 |
| 74 | NKT_m17 | cg05989054 | GAMT | NM_000156 | 00130005 | 0.08 | 0.08 | 0.44 | 0.37 | 0.11 | 0.17 | 0.55 | 147/148 |
| 75 | NKT_m4 | cg26482939 | GNA15 | NM_002068 | 00060558 | 0.06 | 0.04 | 0.24 | 0.28 | 0.09 | 0.10 | 0.55 | 149/150 |
| 76 | NKT_m16 | cg20876010 | CACHD1 | NM_020925 | 00158966 | 0.12 | 0.12 | 0.31 | 0.28 | 0.20 | 0.18 | 0.54 | 151/152 |
| 77 | NKT_m19 | cg15526708 | TGFBR1 | NM_004612 | 00106799 | 0.15 | 0.13 | 0.31 | 0.36 | 0.13 | 0.15 | 0.54 | 153/154 |
| 78 | NKT_m14 | cg22799850 | FBXL13 | NM_145032 | 00161040 | 0.07 | 0.07 | 0.31 | 0.48 | 0.07 | 0.18 | 0.54 | 155/156 |
| 79 | NKT_m18 | cg13105904 | KIAA0323 | NM_015299 | 00100441 | 0.13 | 0.20 | 0.13 | 0.28 | 0.16 | 0.30 | 0.53 | 157/158 |
| 80 | NKT_m20 | cg22268231 | SPIB | NM_003121 | 00269404 | 0.13 | 0.08 | 0.36 | 0.45 | 0.06 | 0.14 | 0.53 | 159/160 |
| 81 | NKT_m10 | cg10784030 | INPP5B | NM_005540 | 00204084 | 0.08 | 0.08 | 0.23 | 0.17 | 0.11 | 0.13 | 0.49 | 161/162 |
| 82 | NKT_m11 | cg19766460 | C21orf128 | NM_152507 | 00184385 | 0.04 | 0.04 | 0.06 | 0.24 | 0.04 | 0.06 | 0.44 | 163/164 |
| 83 | B_nm1 | cg00226923 | FGD2 | NM_173558 | 00146192 | 0.93 | 0.96 | 0.95 | 0.96 | 0.10 | 0.95 | | 165/166 |
| 84 | B_nm2 | cg03860768 | BLK | NM_001715 | 00136573 | 0.83 | 0.88 | 0.87 | 0.86 | 0.11 | 0.82 | | 167/168 |
| 85 | B_nm3 | cg16280667 | BLR1 | NM_001716 | 00160683 | 0.88 | 0.87 | 0.87 | 0.90 | 0.14 | 0.89 | | 169/170 |
| 86 | B_nm4 | cg14127336 | TCL1A | NM_021966 | 00100721 | 0.92 | 0.92 | 0.92 | 0.92 | 0.14 | 0.93 | | 171/172 |
| 87 | B_nm5 | cg22679120 | SNX8 | NM_013321 | 00106266 | 0.64 | 0.65 | 0.59 | 0.63 | 0.15 | 0.72 | 0.64 | 173/174 |
| 88 | B_nm6 | cg16698623 | MGMT | NT_008818 | 00170430 | 0.95 | 0.94 | 0.96 | 0.97 | 0.15 | 0.93 | | 175/176 |
| 89 | B_nm7 | cg10115873 | DNAJB7 | NM_145174 | 00172404 | 0.68 | 0.80 | 0.80 | 0.75 | 0.16 | 0.79 | | 177/178 |
| 90 | B_nm8 | cg27394566 | PLD4 | NM_138790 | 00166428 | 0.72 | 0.56 | 0.88 | 0.89 | 0.16 | 0.85 | | 179/180 |
| 91 | B_nm9 | cg14102807 | CD19 | NM_001770 | 00177455 | 0.88 | 0.90 | 0.92 | 0.93 | 0.16 | 0.89 | | 181/182 |

TABLE 4-continued cell-specific genomic regions

| Pos | Marker-ID | TargetID | SYMBOL | Accession | ENSEMBL (ENSG #) | Granulocytes | Monocytes | CD4+ T-cells | cytotoxic T-cells | B-cells | NK-cells | NK T's | SEQ ID Discovery fragment/ SEQ ID ROI |
|---|---|---|---|---|---|---|---|---|---|---|---|---|---|
| 92 | B_nm10 | cg17399166 | CD1D | NM_001766 | 00158473 | 0.89 | 0.81 | 0.88 | 0.88 | 0.17 | 0.87 | | 183/184 |
| 93 | B_nm11 | cg22194129 | CLEC4C | NM_130441 | 00198178 | 0.85 | 0.88 | 0.90 | 0.92 | 0.17 | 0.85 | | 185/186 |
| 94 | B_nm12 | cg15121304 | — | — | 00197549 | 0.89 | 0.85 | 0.73 | 0.80 | 0.18 | 0.64 | | 187/188 |
| 95 | B_nm13 | cg18979762 | EGLN1 | NM_022051 | 00135766 | 0.80 | 0.84 | 0.83 | 0.81 | 0.19 | 0.72 | | 189/190 |
| 96 | B_nm14 | cg03221619 | FCER2 | NM_002002 | 00104921 | 0.80 | 0.73 | 0.75 | 0.71 | 0.19 | 0.76 | 0.59 | 191/192 |
| 97 | B_nm15 | cg07597976 | CD19 | NM_001770 | 00177455 | 0.72 | 0.63 | 0.63 | 0.68 | 0.20 | 0.60 | 0.58 | 193/194 |
| 98 | B_nm16 | cg00126698 | BTK | NM_000061 | 00010671 | 0.63 | 0.62 | 0.86 | 0.77 | 0.20 | 0.76 | 0.81 | 195/196 |
| 99 | B_nm17 | cg16098726 | GP9 | NM_000174 | 00169704 | 0.71 | 0.82 | 0.92 | 0.91 | 0.20 | 0.87 | | 197/198 |
| 100 | B_nm18 | cg02630207 | FLJ10379 | NM_018079 | 00068784 | 0.73 | 0.74 | 0.71 | 0.68 | 0.21 | 0.65 | 0.67 | 199/200/ |
| 101 | B_nm19 | cg07790638 | LOC91431 | NM_138698 | — | 0.85 | 0.87 | 0.83 | 0.82 | 0.21 | 0.79 | | 201/202 |
| 102 | B_nm20 | cg06667406 | AASS | NM_005763 | 00008311 | 0.85 | 0.84 | 0.85 | 0.83 | 0.22 | 0.81 | | 203/204 |
| 103 | B_nm21 | cg26574610 | VPREB3 | NM_013378 | 00128234 | 0.81 | 0.84 | 0.87 | 0.89 | 0.22 | 0.83 | | 205/206 |
| 104 | B_nm22 | cg07426848 | S100A3 | NM_002960 | 00188015 | 0.88 | 0.89 | 0.93 | 0.92 | 0.22 | 0.87 | | 207/208 |
| 105 | B_nm23 | cg23984130 | | | — | 0.80 | 0.80 | 0.69 | 0.60 | 0.24 | 0.59 | 0.68 | 209/210 |
| 106 | B_nm24 | cg00113020 | LILRB4 | NM_006847 | 00186818 | 0.78 | 0.77 | 0.77 | 0.69 | 0.24 | 0.56 | 0.73 | 211/212 |
| 107 | B_nm25 | cg25769980 | TLR6 | NM_006068 | 00174130 | 0.90 | 0.90 | 0.87 | 0.87 | 0.25 | 0.81 | | 213/214 |
| 108 | B_nm26 | cg16873863 | SLC22A18 | NM_183233 | 00110628 | 0.59 | 0.61 | 0.75 | 0.76 | 0.25 | 0.74 | 0.71 | 215/216 |
| 109 | B_nm27 | cg22295573 | AQP4 | NM_001650 | 00171885 | 0.87 | 0.90 | 0.87 | 0.89 | 0.25 | 0.84 | | 217/218 |
| 110 | B_nm28 | cg18075299 | C14orf54 | NM_173526 | 00172717 | 0.84 | 0.89 | 0.85 | 0.89 | 0.26 | 0.86 | | 219/220 |
| 111 | B_nm29 | cg02399455 | SRI | NM_198901 | 00075142 | 0.88 | 0.87 | 0.90 | 0.86 | 0.26 | 0.78 | | 221/222 |
| 112 | B_nm30 | cg10762615 | FBXW10 | NM_031456 | 00171931 | 0.88 | 0.89 | 0.88 | 0.85 | 0.26 | 0.83 | | 223/224 |
| 113 | B_nm31 | cg18557145 | CD72 | NM_001782 | 00137101 | 0.80 | 0.87 | 0.89 | 0.91 | 0.26 | 0.83 | 0.84 | 225/226 |
| 114 | B_nm32 | cg00374717 | ARSG | NM_014960 | 00141337 | 0.90 | 0.91 | 0.85 | 0.85 | 0.26 | 0.85 | | 227/228 |
| 115 | B_nm33 | cg19437319 | KIAA0196 | NM_014846 | 00164961 | 0.90 | 0.89 | 0.86 | 0.84 | 0.26 | 0.87 | | 229/230 |
| 116 | B_nm34 | cg14959707 | ZC3H7A | NM_014153 | 00122299 | 0.89 | 0.89 | 0.89 | 0.92 | 0.27 | 0.89 | | 231/232 |
| 117 | B_nm35 | cg18152830 | TNFRSF13B | NM_012452 | 00240505 | 0.92 | 0.91 | 0.86 | 0.91 | 0.27 | 0.91 | 0.86 | 233/234 |
| 118 | B_nm36 | cg16593081 | DYX1C1 | NM_001033559 | 00256061 | 0.91 | 0.92 | 0.89 | 0.88 | 0.28 | 0.87 | | 235/236 |
| 119 | B_nm37 | cg26394380 | SFTPB | NM_000542 | 00168878 | 0.66 | 0.80 | 0.72 | 0.75 | 0.29 | 0.86 | 0.70 | 237/238 |
| 120 | B_nm38 | cg01909245 | LSP1 | NM_002339 | 00130592 | 0.87 | 0.84 | 0.64 | 0.63 | 0.30 | 0.71 | 0.62 | 239/240 |
| 121 | B_nm39 | cg03270204 | DDR1 | NM_001954 | 00204580 | 0.94 | 0.92 | 0.84 | 0.92 | 0.31 | 0.94 | | 241/242 |
| 122 | B_nm40 | cg11042320 | PDGFRB | NM_002609 | 00113721 | 0.67 | 0.74 | 0.73 | 0.79 | 0.32 | 0.63 | 0.73 | 243/244 |
| 123 | B_nm41 | cg08251036 | MGAT5 | NM_002410 | 00152127 | 0.83 | 0.87 | 0.83 | 0.79 | 0.32 | 0.68 | 0.83 | 245/246 |
| 124 | B_nm42 | cg05921699 | CD79A | NM_001783 | 00105369 | 0.84 | 0.81 | 0.80 | 0.67 | 0.32 | 0.70 | 0.78 | 247/248 |
| 125 | B_nm43 | cg25211252 | KCNMB3 | NM_014407 | 00171121 | 0.86 | 0.83 | 0.83 | 0.83 | 0.34 | 0.83 | 0.80 | 249/250 |
| 126 | B_nm44 | cg21960110 | HBZ | NM_005332 | 00130656 | 0.85 | 0.88 | 0.80 | 0.69 | 0.36 | 0.81 | 0.57 | 251/252 |
| 127 | B_m1 | cg27398547 | C14orf39 | NM_174978 | 00179008 | 0.27 | 0.19 | 0.22 | 0.21 | 0.73 | 0.26 | | 253/254 |
| 128 | B_m2 | cg22226839 | ATP2B4 | NM_001684 | 00058668 | 0.16 | 0.18 | 0.25 | 0.23 | 0.72 | 0.34 | | 255/256 |
| 129 | B_m3 | cg11997899 | DLX5 | NM_005221 | 00105880 | 0.30 | 0.23 | 0.29 | 0.21 | 0.72 | 0.28 | | 257/258 |
| 130 | B_m4 | cg19350340 | ASPM | NM_018136 | 00066279 | 0.14 | 0.13 | 0.16 | 0.20 | 0.72 | 0.22 | | 259/260 |
| 131 | B_m5 | cg00049986 | C14orf10 | NM_017917 | 00092020 | 0.17 | 0.11 | 0.21 | 0.17 | 0.70 | 0.20 | | 261/262 |
| 132 | B_m6 | cg08360728 | GPATC3 | NM_022078 | 00198758 | 0.28 | 0.31 | 0.33 | 0.24 | 0.69 | 0.31 | | 263/264 |
| 133 | B_m7 | cg01222684 | TTC1 | NM_003314 | 00113312 | 0.06 | 0.05 | 0.10 | 0.05 | 0.66 | 0.14 | | 265/266 |
| 134 | B_m8 | cg00571634 | WDR5B | NM_019069 | 00196981 | 0.18 | 0.18 | 0.16 | 0.16 | 0.65 | 0.20 | | 267/268 |
| 135 | B_m9 | cg18908499 | C1orf150 | NM_145278 | 00169224 | 0.13 | 0.13 | 0.20 | 0.16 | 0.65 | 0.23 | | 269/270 |
| 136 | B_m10 | cg00678539 | MNS1 | NM_018365 | 00138587 | 0.12 | 0.13 | 0.19 | 0.18 | 0.60 | 0.15 | | 271/272 |
| 137 | B_m11 | cg19756611 | DACH1 | NM_004392 | 00165659 | 0.17 | 0.07 | 0.15 | 0.14 | 0.59 | 0.26 | | 273/274 |
| 138 | B_m12 | cg23668631 | CAMKK1 | NM_032294 | 00004660 | 0.10 | 0.22 | 0.36 | 0.44 | 0.58 | 0.44 | 0.35 | 275/276 |
| 139 | B_m13 | cg18967846 | CLDN12 | NM_012129 | 00157224 | 0.14 | 0.14 | 0.16 | 0.10 | 0.58 | 0.24 | | 277/278 |
| 140 | B_m14 | cg25482967 | MRPS10 | NM_018141 | 00048544 | 0.12 | 0.09 | 0.14 | 0.11 | 0.56 | 0.17 | | 279/280 |
| 141 | B_m15 | cg06751597 | SNAP23 | NM_003825 | 00092035 | 0.07 | 0.07 | 0.11 | 0.09 | 0.56 | 0.07 | | 281/282 |
| 142 | B_m16 | cg22285621 | SSH3 | NM_018276 | 00172830 | 0.01 | 0.08 | 0.05 | 0.11 | 0.55 | 0.07 | | 283/284 |
| 143 | B_m17 | cg17378989 | ERCC1 | NM_202001 | 00012061 | 0.11 | 0.12 | 0.12 | 0.12 | 0.55 | 0.17 | | 285/286 |
| 144 | B_m18 | cg03825921 | RAB4A | NM_004578 | 00168118 | 0.11 | 0.11 | 0.14 | 0.13 | 0.55 | 0.18 | | 287/288 |
| 145 | B_m19 | cg11250058 | RAPH1 | NM_203365 | 00173166 | 0.06 | 0.08 | 0.07 | 0.24 | 0.55 | 0.09 | | 289/290 |
| 146 | B_m20 | cg03643709 | VPS18 | NM_020857 | 00104142 | 0.18 | 0.13 | 0.19 | 0.10 | 0.54 | 0.22 | | 291/292 |
| 147 | B_m21 | cg24641737 | DENND2D | NM_024901 | 00162777 | 0.03 | 0.03 | 0.04 | 0.03 | 0.54 | 0.05 | | 293/294 |
| 148 | B_m22 | cg07732037 | MPHOSPH9 | NM_022782 | 00051825 | 0.27 | 0.47 | 0.06 | 0.10 | 0.53 | 0.25 | 0.09 | 295/296 |
| 149 | B_m23 | cg05091653 | SP100 | NM_003113 | 00067066 | 0.08 | 0.06 | 0.04 | 0.05 | 0.52 | 0.06 | | 297/298 |
| 150 | B_m24 | cg16007628 | ZNF207 | NM_001032293 | 00010244 | 0.13 | 0.15 | 0.17 | 0.15 | 0.52 | 0.18 | 0.22 | 299/300 |
| 151 | B_m25 | cg26954174 | CARD15 | NM_022162 | 00167207 | 0.07 | 0.07 | 0.25 | 0.38 | 0.51 | 0.14 | 0.26 | 301/302 |
| 152 | B_m26 | cg01988129 | ADHFE1 | NM_144650 | 00147576 | 0.16 | 0.18 | 0.20 | 0.22 | 0.50 | 0.20 | 0.19 | 303/304 |
| 153 | CD8_nm1 | cg18149207 | RORC | NM_005060 | 00143836 | 0.83 | 0.87 | 0.65 | 0.31 | 0.60 | 0.75 | | 305/306 |
| 154 | CD8_nm2 | cg02519218 | CHFR | NT_024477 | 00072609 | 0.85 | 0.84 | 0.52 | 0.39 | 0.60 | 0.71 | 0.62 | 307/308 |
| 155 | CD8_nm3 | cg21755709 | C21orf124 | NM_032920 | 00136014 | 0.66 | 0.71 | 0.65 | 0.43 | 0.63 | 0.64 | 0.66 | 309/310 |
| 156 | CD8_nm4 | cg24019564 | RUNX3 | NT_004610 | 00020633 | 0.55 | 0.75 | 0.67 | 0.44 | 0.74 | 0.51 | 0.62 | 311/312 |
| 157 | CD8_nm5 | cg19700658 | UCP3 | NM_003356 | 00175564 | 0.83 | 0.84 | 0.69 | 0.44 | 0.78 | 0.54 | 0.54 | 313/314 |
| 158 | CD8_nm6 | cg14027234 | CD248 | NM_020404 | 00174807 | 0.83 | 0.83 | 0.82 | 0.45 | 0.71 | 0.82 | | 315/316 |

TABLE 4-continued cell-specific genomic regions

| Pos | Marker-ID | TargetID | SYMBOL | Accession | ENSEMBL (ENSG #) | Granulocytes | Monocytes | CD4+ cells | cytotoxic T-cells | B-cells | NK-cells | NK T's | SEQ ID Discovery fragment/ SEQ ID ROI |
|---|---|---|---|---|---|---|---|---|---|---|---|---|---|
| 159 | CD8_nm7 | cg03024246 | JRKL | NM_003772 | 00183340 | 0.69 | 0.78 | 0.77 | 0.45 | 0.53 | 0.63 | 0.67 | 317/318 |
| 160 | CD8_nm8 | cg21232015 | CHFR | NT_024477 | 00072609 | 0.87 | 0.88 | 0.61 | 0.46 | 0.63 | 0.81 | 0.73 | 319/320 |
| 161 | CD8_nm9 | cg12108912 | MGC10993 | NM_030577 | 00144120 | 0.82 | 0.85 | 0.50 | 0.47 | 0.57 | 0.73 | 0.77 | 321/322 |
| 162 | CD8_nm10 | cg17505463 | GGT3 | NM_002058 | 00197421 | 0.82 | 0.80 | 0.59 | 0.47 | 0.69 | 0.66 | 0.60 | 323/324 |
| 163 | CD8_nm11 | cg07232688 | LRRC39 | NM_144620 | 00122477 | 0.71 | 0.75 | 0.72 | 0.47 | 0.59 | 0.50 | 0.64 | 325/326 |
| 164 | CD8_m1 | cg26848126 | CYSLTR1 | NM_006639 | 00173198 | 0.12 | 0.04 | 0.18 | 0.72 | 0.26 | 0.10 | | 327/328 |
| 165 | CD8_m3 | cg25511807 | MMP7 | NM_002423 | 00137673 | 0.09 | 0.09 | 0.43 | 0.62 | 0.27 | 0.44 | | 329/330 |
| 166 | CD8_m4 | cg16604516 | FBLN2 | NM_001004019 | 00163520 | 0.19 | 0.15 | 0.40 | 0.61 | 0.16 | 0.15 | | 331/332 |
| 167 | CD8_m5 | cg23771929 | FREQ | NM_014286 | 00107130 | 0.20 | 0.21 | 0.46 | 0.60 | 0.28 | 0.34 | 0.46 | 333/334 |
| 168 | CD8_m6 | cg20340242 | IL1R2 | NM_004633 | 00115590 | 0.03 | 0.04 | 0.44 | 0.60 | 0.18 | 0.42 | | 335/336 |
| 169 | CD8_m7 | cg09106999 | CDK2 | NM_001798 | 00123374 | 0.07 | 0.08 | 0.48 | 0.60 | 0.29 | 0.29 | | 337/338 |
| 170 | CD8_m8 | cg00516481 | PDE9A | NM_002606 | 00160191 | 0.19 | 0.18 | 0.49 | 0.57 | 0.18 | 0.32 | 0.46 | 339/340 |
| 171 | CD8_m9 | cg22054164 | ECE1 | NM_001397 | 00117298 | 0.17 | 0.09 | 0.28 | 0.57 | 0.17 | 0.42 | | 341/342 |
| 172 | CD8_m10 | cg06415153 | PITPNM2 | NM_020845 | 00090975 | 0.19 | 0.12 | 0.39 | 0.56 | 0.22 | 0.40 | | 343/344 |
| 173 | CD8_m11 | cg22778947 | FSD1NL | NM_031919 | 00106701 | 0.16 | 0.18 | 0.50 | 0.55 | 0.18 | 0.33 | | 345/346 |
| 174 | CD8_m12 | cg03627896 | LOC283932 | NM_175901 | — | 0.34 | 0.41 | 0.31 | 0.53 | 0.21 | 0.31 | 0.12 | 347/348 |
| 175 | CD8_m13 | cg00833777 | ITGAM | NM_000632 | 00169896 | 0.08 | 0.09 | 0.42 | 0.52 | 0.25 | 0.16 | | 349/350 |
| 176 | CD8_m14 | cg01356829 | IL12RB2 | NM_001559 | 00081985 | 0.08 | 0.07 | 0.38 | 0.52 | 0.15 | 0.12 | 0.16 | 351/352 |
| 177 | CD8_m15 | cg18661868 | FES | NM_002005 | 00182511 | 0.08 | 0.11 | 0.34 | 0.51 | 0.29 | 0.13 | | 353/354 |
| 178 | CD8_m16 | cg08899626 | LDB2 | NM_001290 | 00169744 | 0.05 | 0.09 | 0.18 | 0.51 | 0.18 | 0.12 | | 355/356 |
| 179 | CD8_m17 | cg14700707 | NOTCH4 | NM_004557 | 00204301 | 0.05 | 0.05 | 0.39 | 0.50 | 0.14 | 0.35 | 0.30 | 357/358 |
| 180 | CD4_nm1 | cg03602500 | FLJ00060 | NM_033206 | 00104970 | 0.86 | 0.85 | 0.26 | 0.52 | 0.66 | 0.87 | | 359/360 |
| 181 | CD4_nm2 | cg16470760 | CD4 | NM_000616 | 00010610 | 0.74 | 0.70 | 0.31 | 0.61 | 0.68 | 0.66 | 0.67 | 361/362 |
| 182 | CD4_nm3 | cg02989940 | ERAF | NM_016633 | 00169897 | 0.90 | 0.87 | 0.39 | 0.64 | 0.55 | 0.79 | 0.72 | 363/364 |
| 183 | CD4_nm4 | cg22972055 | UNC84A | NM_025154 | 00164828 | 0.91 | 0.93 | 0.42 | 0.64 | 0.50 | 0.89 | | 365/366 |
| 184 | CD4_nm5 | cf29335340 | PTPN6 | NM_002831 | 00111679 | 0.66 | 0.73 | 0.42 | 0.64 | 0.59 | 0.78 | 0.57 | 367/368 |
| 185 | CD4_nm6 | cg08214029 | CCL18 | NM_002988 | 00006074 | 0.74 | 0.78 | 0.42 | 0.76 | 0.58 | 0.80 | 0.72 | 369/370 |
| 186 | CD4_nm7 | cg02385474 | PCNXL2 | NM_024938 | 00135749 | 0.78 | 0.78 | 0.43 | 0.52 | 0.54 | 0.65 | 0.62 | 371/372 |
| 187 | CD4_nm8 | cg01782486 | ZBTB7B | NM_015872 | 00160685 | 0.75 | 0.82 | 0.44 | 0.88 | 0.52 | 0.81 | 0.83 | 373/374 |
| 188 | CD4_nm9 | cg25598083 | ACOT2 | NM_006821 | 00119673 | 0.85 | 0.86 | 0.44 | 0.55 | 0.65 | 0.72 | 0.54 | 375/376 |
| 189 | CD4_nm10 | cg07327347 | AQP8 | NM_001169 | 00103375 | 0.88 | 0.65 | 0.46 | 0.70 | 0.67 | 0.79 | 0.54 | 377/378 |
| 190 | CD4_nm11 | cg12703269 | PSTPIP1 | NM_003978 | 00140368 | 0.82 | 0.82 | 0.46 | 0.61 | 0.80 | 0.84 | 0.59 | 379/380 |
| 191 | CD4_nm12 | cg23909633 | IL24 | NM_181339 | 00162892 | 0.87 | 0.87 | 0.48 | 0.65 | 0.74 | 0.76 | 0.80 | 381/382 |
| 192 | CD4_nm13 | cg18669588 | PTK9L | NM_007284 | 00247596 | 0.80 | 0.83 | 0.50 | 0.64 | 0.75 | 0.77 | 0.62 | 383/384 |
| 193 | CD4_m1 | cg25655096 | GPR92 | NM_020400 | 00184574 | 0.44 | 0.19 | 0.69 | 0.49 | 0.19 | 0.13 | | 385/386 |
| 194 | CD4_m2 | cg05697976 | MLSTD1 | NM_018099 | 00064763 | 0.09 | 0.14 | 0.62 | 0.50 | 0.42 | 0.36 | 0.48 | 387/388 |
| 195 | CD4_m3 | cg10521852 | EDG4 | NM_004720 | 00064547 | 0.07 | 0.08 | 0.61 | 0.41 | 0.22 | 0.22 | 0.35 | 389/390 |
| 196 | CD4_m4 | cg08159444 | PNMA5 | NM_052926 | 00198883 | 0.26 | 0.06 | 0.61 | 0.48 | 0.48 | 0.46 | | 391/392 |
| 197 | CD4_m5 | cg00443307 | KLRG1 | NM_005810 | 00139187 | 0.37 | 0.22 | 0.60 | 0.38 | 0.34 | 0.35 | 0.29 | 393/394 |
| 198 | CD4_m6 | cg04541607 | CRYBB1 | NM_001887 | 00100122 | 0.06 | 0.10 | 0.59 | 0.46 | 0.14 | 0.47 | | 395/396 |
| 199 | CD4_m7 | cg03085312 | RARA | NM_001024809 | 00131759 | 0.16 | 0.15 | 0.59 | 0.38 | 0.18 | 0.17 | 0.39 | 397/398 |
| 200 | CD4_m8 | cg20764656 | GPX2 | NM_002083 | 00176153 | 0.04 | 0.06 | 0.58 | 0.47 | 0.17 | 0.12 | 0.34 | 399/400 |
| 201 | CD4_m9 | cg07837085 | SLAMF7 | NM_021181 | 00026751 | 0.06 | 0.07 | 0.57 | 0.35 | 0.27 | 0.07 | | 401/402 |
| 202 | CD4_m10 | cg18440048 | ZNF70 | NM_021916 | 00187792 | 0.12 | 0.17 | 0.56 | 0.21 | 0.13 | 0.20 | 0.34 | 403/404 |
| 203 | CD4_m11 | cg18752880 | C1QTNF3 | NM_181435 | 00082196 | 0.06 | 0.29 | 0.56 | 0.46 | 0.46 | 0.15 | 0.21 | 405/406 |
| 204 | CD4_m12 | cg24576425 | GALNT5 | NM_014568 | 00136542 | 0.11 | 0.08 | 0.56 | 0.46 | 0.26 | 0.24 | 0.46 | 407/408 |
| 205 | CD4_m13 | cg18055007 | DDAH2 | NM_013974 | 00226634 | 0.11 | 0.08 | 0.55 | 0.21 | 0.15 | 0.13 | 0.14 | 409/410 |
| 206 | CD4_m14 | cg14913610 | KLRG1 | NM_005810 | 00139187 | 0.06 | 0.07 | 0.55 | 0.43 | 0.18 | 0.16 | 0.17 | 411/412 |
| 207 | CD4_m15 | cg00563926 | TGFBR3 | NM_003243 | 00069702 | 0.11 | 0.10 | 0.55 | 0.15 | 0.18 | 0.17 | 0.38 | 413/414 |
| 208 | CD4_m16 | cg05252264 | FCAR | NM_002000 | 00186431 | 0.06 | 0.08 | 0.55 | 0.47 | 0.21 | 0.38 | | 415/416 |
| 209 | CD4_m17 | cg16465939 | KCNQ1 | NT_009237 | 00053918 | 0.05 | 0.05 | 0.54 | 0.22 | 0.28 | 0.11 | | 417/418 |
| 210 | CD4_m18 | cg19963522 | PIP3-E | NM_015553 | 00074706 | 0.09 | 0.11 | 0.54. | 0.38 | 0.19 | 0.32 | 0.46 | 419/420 |
| 211 | CD4_m19 | cg05512099 | PLEKHF1 | NM_024310 | 00166289 | 0.15 | 0.19 | 0.54 | 0.42 | 0.18 | 0.11 | 0.21 | 421/422 |
| 212 | CD4_m20 | cg07376232 | AMICA1 | NM_153206 | 00160593 | 0.05 | 0.03 | 0.52 | 0.36 | 0.21 | 0.20 | | 423/424 |
| 213 | CD4_m21 | cg18059933 | TP53INP1 | NM_033285 | 00164938 | 0.23 | 0.16 | 0.50 | 0.43 | 0.10 | 0.10 | 0.31 | 425/426 |
| 214 | MOC_nm1 | cg02780988 | KRTHA6 | NM_003771 | 00126337 | 0.71 | 0.08 | 0.69 | 0.64 | 0.54 | 0.64 | 0.62 | 427/428 |
| 215 | MOC_nm2 | cg18854666 | SLC11A1 | NM_000578 | 00018280 | 0.61 | 0.14 | 0.94 | 0.94 | 0.79 | 0.92 | | 429/430 |
| 216 | MOC_nm3 | cg18589858 | SLCO2B1 | NM_007256 | 00137491 | 0.73 | 0.15 | 0.89 | 0.86 | 0.58 | 0.81 | | 431/432 |
| 217 | MOC_nm4 | cg22456522 | LILRB3 | NM_006864 | 00204577 | 0.84 | 0.17 | 0.80 | 0.83 | 0.68 | 0.80 | | 433/434 |
| 218 | MOC_nm5 | cg27443224 | CCL21 | NM_002989 | 00137077 | 0.67 | 0.17 | 0.63 | 0.60 | 0.52 | 0.52 | 0.64 | 435/436 |
| 219 | MOC_nm6 | cg22954818 | APOBEC3A | NM_145699 | 00128383 | 0.55 | 0.20 | 0.65 | 0.61 | 0.50 | 0.65 | 0.64 | 437/438 |
| 220 | MOC_nm7 | cg05445326 | TM4SF19 | NM_138461 | 00145107 | 0.91 | 0.21 | 0.93 | 0.93 | 0.58 | 0.64 | | 439/440 |
| 221 | MOC_nm8 | cg10045881 | CHI3L2 | NM_001025197 | 00064886 | 0.61 | 0.21 | 0.66 | 0.73 | 0.62 | 0.69 | 0.77 | 441/442 |
| 222 | MOC_nm9 | cg11051139 | LOC144501 | NM_182507 | 00167767 | 0.58 | 0.21 | 0.76 | 0.77 | 0.74 | 0.70 | 0.71 | 443/444 |
| 223 | MOC_nm11 | cg01193293 | SIGLEC7 | NM_014385 | 00168995 | 0.65 | 0.29 | 0.66 | 0.66 | 0.60 | 0.50 | | 445/446 |
| 224 | MOC_nm12 | cg04387658 | CD86 | NM_006889 | 00114013 | 0.55 | 0.33 | 0.76 | 0.72 | 0.58 | 0.57 | 0.80 | 447/448 |
| 225 | MOC_nm13 | cg22319147 | CDH5 | NM_001795 | 00179776 | 0.56 | 0.34 | 0.95 | 0.95 | 0.72 | 0.90 | | 449/450 |

TABLE 4-continued cell-specific genomic regions

| Pos | Marker-ID | TargetID | SYMBOL | Accession | ENSEMBL (ENSG #) | Granulocytes | Monocytes | CD4+ T-cells | cytotoxic T-cells | B-cells | NK-cells | NK T's | SEQ ID Discovery fragment/ SEQ ID ROI |
|---|---|---|---|---|---|---|---|---|---|---|---|---|---|
| 226 | MOC_nm14 | cg13253729 | Rgr | NM_153615 | 00159496 | 0.85 | 0.41 | 0.94 | 0.93 | 0.53 | 0.90 | | 451/452 |
| 227 | MOC_nm15 | cg00412772 | C19orf33 | NM_033520 | 00167644 | 0.57 | 0.42 | 0.74 | 0.72 | 0.52 | 0.62 | | 453/454 |
| 228 | MOC_nm16 | cg07986773 | NUP50 | NM_153645 | 00093000 | 0.85 | 0.42 | 0.90 | 0.89 | 0.77 | 0.83 | | 455/456 |
| 229 | MOC_nm17 | cg06407137 | CD300LB | NM_174892 | 00178789 | 0.78 | 0.42 | 0.84 | 0.79 | 0.80 | 0.74 | 0.85 | 457/458 |
| 230 | MOC_nm18 | cg12564453 | CETP | NM_000078 | 00087237 | 0.61 | 0.44 | 0.95 | 0.94 | 0.65 | 0.66 | | 459/460 |
| 231 | MOC_nm19 | cg02497428 | IGSF6 | NM_005849 | 00140749 | 0.92 | 0.48 | 0.95 | 0.95 | 0.77 | 0.94 | | 461/462 |
| 232 | MOC_nm20 | cg16501235 | C1orf54 | NM_024579 | 00118292 | 0.83 | 0.48 | 0.86 | 0.82 | 0.75 | 0.83 | 0.81 | 463/464 |
| 233 | MOC_meth1 | cg05044994 | FLJ42393 | NM_207488 | 00213132 | 0.47 | 0.74 | 0.16 | 0.24 | 0.32 | 0.17 | | 465/466 |
| 234 | MOC_meth2 | cg23213217 | DEGS1 | NM_144780 | 00143753 | 0.04 | 0.73 | 0.04 | 0.03 | 0.24 | 0.38 | | 467/468 |
| 235 | MOC_meth3 | cg24921858 | BCL2L14 | NM_030766 | 00121380 | 0.48 | 0.64 | 0.44 | 0.42 | 0.22 | 0.46 | | 469/470 |
| 236 | MOC_meth4 | cg07747299 | C21orf56 | NM_032261 | 00160284 | 0.47 | 0.63 | 0.39 | 0.35 | 0.34 | 0.37 | 0.27 | 471/472 |
| 237 | MOC_meth5 | cg20839025 | PRSS7 | NM_002772 | 00154746 | 0.43 | 0.63 | 0.43 | 0.38 | 0.40 | 0.31 | 0.32 | 473/474 |
| 238 | MOC_meth6 | cg15551881 | TRAF1 | NM_005658 | 00056558 | 0.08 | 0.62 | 0.16 | 0.06 | 0.48 | 0.21 | | 475/476 |
| 239 | MOC_meth7 | cg17233935 | DSCR10 | NM_148676 | 00233316 | 0.46 | 0.62 | 0.39 | 0.32 | 0.32 | 0.38 | 0.31 | 477/478 |
| 240 | MOC_meth8 | cg07376029 | GC | NM_000583 | 00145321 | 0.47 | 0.61 | 0.25 | 0.37 | 0.31 | 0.39 | 0.31 | 479/480 |
| 241 | MOC_meth9 | cg14893161 | FLJ32569 | NM_152491 | 00162877 | 0.36 | 0.59 | 0.35 | 0.22 | 0.40 | 0.30 | 0.25 | 481/482 |
| 242 | MOC_meth10 | cg24884084 | SPRR1B | NM_003125 | 00169469 | 0.45 | 0.57 | 0.39 | 0.43 | 0.24 | 0.41 | | 483/484 |
| 243 | MOC_meth11 | cg12022621 | LAX1 | NM_017773 | 00122188 | 0.48 | 0.56 | 0.02 | 0.03 | 0.34 | 0.10 | | 485/486 |
| 244 | MOC_meth12 | cg16399745 | CNAP1 | NM_014865 | 00010292 | 0.45 | 0.54 | 0.27 | 0.26 | 0.29 | 0.13 | 0.10 | 487/488 |
| 245 | MOC_meth13 | cg10117369 | LAX1 | NM_017773 | 00122188 | 0.46 | 0.53 | 0.02 | 0.05 | 0.43 | 0.15 | | 489/490 |
| 246 | MOC_meth14 | cg24988345 | SCHIP1 | NM_014575 | 00250588 | 0.44 | 0.51 | 0.22 | 0.27 | 0.26 | 0.14 | 0.25 | 491/492 |
| 247 | MOC_meth15 | cg03427831 | MTHFR | NM_005957 | 00177000 | 0.36 | 0.50 | 0.27 | 0.25 | 0.24 | 0.13 | 0.08 | 493/494 |
| 248 | MOC_meth16 | cg05546044 | MAPK1 | NM_002745 | 00100030 | 0.30 | 0.50 | 0.15 | 0.18 | 0.16 | 0.12 | | 495/496 |
| 249 | GRC_nm1 | cg22381196 | DHODH | NM_001361 | 00102967 | 0.05 | 0.72 | 0.89 | 0.84 | 0.78 | 0.78 | 0.87 | 497/498 |
| 250 | GRC_nm2 | cg06270401 | DYRK4 | NM_003845 | 00010219 | 0.06 | 0.80 | 0.84 | 0.82 | 0.79 | 0.81 | 0.75 | 499/500 |
| 251 | GRC_nm3 | cg22266967 | S100P | NM_005980 | 00163993 | 0.08 | 0.56 | 0.71 | 0.69 | 0.58 | 0.66 | 0.60 | 501/502 |
| 252 | GRC_nm4 | cg21283680 | SH3BP5 | NM_004844 | 00131370 | 0.12 | 0.60 | 0.77 | 0.72 | 0.61 | 0.64 | 0.74 | 503/504 |
| 253 | GRC_nm5 | cg20720686 | POR | NM_000941 | 00127948 | 0.15 | 0.52 | 0.80 | 0.77 | 0.76 | 0.74 | 0.74 | 505/506 |
| 254 | GRC_nm6 | cg12949760 | KCNQ1 | NT_009237 | 00053918 | 0.17 | 0.58 | 0.76 | 0.77 | 0.60 | 0.77 | 0.66 | 507/508 |
| 255 | GRC_nm7 | cg01718139 | UNQ3033 | NM_198481 | 00189068 | 0.18 | 0.72 | 0.78 | 0.72 | 0.78 | 0.78 | 0.74 | 509/510 |
| 256 | GRC_nm8 | cg05681757 | FGD4 | NM_139241 | 00139132 | 0.19 | 0.71 | 0.66 | 0.69 | 0.67 | 0.74 | 0.57 | 511/512 |
| 257 | GRC_nm9 | cg00145118 | GNPDA1 | NM_005471 | 00113552 | 0.19 | 0.51 | 0.60 | 0.67 | 0.58 | 0.62 | 0.74 | 513/514 |
| 258 | GRC_nm10 | cg10758292 | DEFA1 | NM_004084 | 00206047 | 0.20 | 0.90 | 0.76 | 0.75 | 0.78 | 0.83 | 0.75 | 515/516 |
| 259 | nGRC_nm11 | cg22438810 | LCN2 | NM_005564 | 00148346 | 0.20 | 0.81 | 0.74 | 0.72 | 0.65 | 0.60 | 0.64 | 517/518 |
| 260 | GRC_nm12 | cg02593766 | EPN3 | NM_017957 | 00049283 | 0.20 | 0.67 | 0.81 | 0.71 | 0.76 | 0.83 | 0.73 | 519/520 |
| 261 | GRC_nm13 | cg06625767 | F12 | NM_000505 | 00131187 | 0.21 | 0.65 | 0.87 | 0.87 | 0.86 | 0.86 | 0.89 | 521/522 |
| 262 | GRC_nm14 | cg18934187 | STARD6 | NM_139171 | 00174448 | 0.22 | 0.74 | 0.77 | 0.62 | 0.62 | 0.55 | 0.72 | 523/524 |
| 263 | GRC_nm15 | cg26306976 | ITGB1BP1 | NM_022334 | 00119185 | 0.22 | 0.92 | 0.90 | 0.87 | 0.81 | 0.87 | 0.72 | 525/526 |
| 264 | GRC_nm16 | cg09948350 | FLJ25084 | NM_152792 | 00244617 | 0.23 | 0.67 | 0.72 | 0.64 | 0.59 | 0.66 | 0.71 | 527/528 |
| 265 | GRC_nm17 | cg13265003 | SLC37A1 | NM_018964 | 00160190 | 0.24 | 0.75 | 0.81 | 0.81 | 0.69 | 0.79 | 0.74 | 529/530 |
| 266 | GRC_nm18 | cg25600606 | HIPK3 | NM_005734 | 00110025 | 0.25 | 0.86 | 0.91 | 0.84 | 0.77 | 0.89 | 0.88 | 531/532 |
| 267 | GRC_nm19 | cg12788313 | MST1 | NM_020998 | 00173531 | 0.26 | 0.64 | 0.92 | 0.93 | 0.82 | 0.89 | | 533/534 |
| 268 | GRC_nm20 | cg17051440 | CLDN2 | NM_020384 | 00165376 | 0.27 | 0.61 | 0.79 | 0.77 | 0.68 | 0.57 | 0.71 | 535/536 |
| 269 | GRC_nm21 | cg24422489 | FCGR2A | NM_021642 | 00143226 | 0.27 | 0.68 | 0.80 | 0.73 | 0.68 | 0.70 | 0.81 | 537/538 |
| 270 | GRC_nm22 | cg15361231 | GLRX2 | NM_016066 | 00023572 | 0.27 | 0.64 | 0.83 | 0.75 | 0.62 | 0.67 | 0.77 | 539/540 |
| 271 | GRC_nm23 | cg10591659 | NYX | NM_022567 | 00188937 | 0.28 | 0.88 | 0.89 | 0.82 | 0.76 | 0.59 | 0.84 | 541/542 |
| 272 | GRC_nm24 | cg20098659 | CLEC9A | NM_207345 | 00197992 | 0.29 | 0.86 | 0.89 | 0.89 | 0.53 | 0.86 | | 543/544 |
| 273 | GRC_nm25 | cg16504798 | MYO1F | NM_012335 | 00142347 | 0.30 | 0.56 | 0.88 | 0.79 | 0.77 | 0.69 | | 545/546 |
| 274 | GRC_nm26 | cg15379858 | ChGn | NM_018371 | 00147408 | 0.31 | 0.92 | 0.93 | 0.93 | 0.93 | 0.94 | 0.87 | 547/548 |
| 275 | GRC_nm27 | cg07423149 | CHI3L1 | NM_001276 | 00133048 | 0.32 | 0.51 | 0.79 | 0.84 | 0.78 | 0.72 | 0.76 | 549/550 |
| 276 | GRC_nm28 | cg17823175 | AZU1 | NM_001700 | 00172232 | 0.35 | 0.52 | 0.85 | 0.85 | 0.85 | 0.87 | 0.83 | 551/552 |
| 277 | GRC_nm29 | cg21685427 | SGK2 | NM_016276 | 00101049 | 0.36 | 0.60 | 0.90 | 0.90 | 0.91 | 0.91 | 0.87 | 553/554 |
| 278 | GRC_nm30 | cg11849692 | LDB1 | NM_003893 | 00198728 | 0.36 | 0.71 | 0.60 | 0.79 | 0.57 | 0.89 | | 555/556 |
| 279 | GRC_nm31 | cg22286764 | C3orf35 | NM_178339 | 00198950 | 037 | 0.81 | 0.94 | 0.95 | 0.67 | 0.95 | | 557/558 |
| 280 | GRC_nm32 | cg18530324 | KIAA0427 | NM_014772 | 00134030 | 0.38 | 0.52 | 0.86 | 0.87 | 0.78 | 0.80 | | 559/560 |
| 281 | GRC_nm33 | cg22630748 | INHBE | NM_031479 | 00139269 | 0.39 | 0.74 | 0.94 | 0.93 | 0.93 | 0.93 | 0.90 | 561/562 |
| 282 | GRC_nm34 | cg03311899 | GPR109A | NM_177551 | 00182782 | 0.43 | 0.54 | 0.95 | 0.93 | 0.92 | 0.91 | 0.95 | 563/564 |
| 283 | GRC_nm35 | cg00840516 | HYAL2 | NM_003773 | 00261921 | 0.43 | 0.75 | 0.91 | 0.88 | 0.89 | 0.84 | | 565/566 |
| 284 | GRC_nm36 | cg02039171 | CEBPE | NM_001805 | 00092067 | 0.43 | 0.80 | 0.94 | 0.95 | 0.95 | 0.94 | 0.92 | 567/568 |
| 285 | GRC_nm37 | cg05826823 | CIZ1 | NM_012127 | 00148337 | 0.46 | 0.83 | 0.94 | 0.92 | 0.81 | 0.85 | | 569/570 |
| 286 | GRC_m1 | cg02212836 | LY86 | NM_004271 | 00112799 | 0.90 | 0.14 | 0.08 | 0.14 | 0.07 | 0.42 | | 571/572 |
| 287 | GRC_m2 | cg08136806 | KRT6E | NM_173086 | 00170465 | 0.65 | 0.48 | 0.32 | 0.39 | 0.41 | 0.39 | 0.27 | 573/574 |
| 288 | GRC_m3 | cg18959422 | MYBPH | NM_004997 | 00133055 | 0.64 | 0.41 | 0.41 | 0.48 | 0.37 | 0.42 | 0.34 | 575/576 |
| 289 | GRC_m4 | cg05106502 | SCAP1 | NM_003726 | 00141293 | 0.61 | 0.49 | 0.03 | 0.03 | 0.10 | 0.04 | | 577/578 |
| 290 | GRC_m5 | cg10896774 | C7orf34 | NM_178829 | 00165131 | 0.55 | 0.45 | 0.18 | 0.22 | 0.23 | 0.38 | 0.12 | 579/580 |
| 291 | GRC_m6 | cg00323915 | GIMAP4 | NM_018326 | 00133574 | 0.55 | 0.42 | 0.17 | 0.28 | 0.43 | 0.20 | 0.19 | 581/582 |
| 292 | GRC_m7 | cg12605747 | RPL4 | NM_000968 | 00174444 | 0.54 | 0.41 | 0.36 | 0.33 | 0.31 | 0.26 | 0.34 | 583/584 |

TABLE 4-continued cell-specific genomic regions

| Pos | Marker-ID | TargetID | SYMBOL | Accession | ENSEMBL (ENSG #) | Granulocytes | Monocytes | CD4+ T-cells | cytotoxic T-cells | B-cells | NK-cells | NK T's | SEQ ID Discovery fragment/ SEQ ID ROI |
|---|---|---|---|---|---|---|---|---|---|---|---|---|---|
| 293 | GRC_m8 | cg15625636 | GPR65 | NM_003608 | 00140030 | 0.54 | 0.32 | 0.12 | 0.20 | 0.29 | 0.31 | 0.25 | 585/586 |
| 294 | GRC_m9 | cg12810837 | CLEC2D | NM_001004419 | 00069493 | 0.52 | 0.45 | 0.11 | 0.15 | 0.18 | 0.14 | 0.16 | 587/588 |
| 295 | GRC_m10 | cg26839325 | BMP15 | NM_005448 | 00130385 | 0.52 | 0.45 | 0.24 | 0.24 | 0.24 | 0.27 | 0.18 | 589/590 |
| 296 | eGRC_nm1 | NA | PRG2 | | 00186652 | NA | NA | NA | NA | NA | NA | NA | 591/592 |
| 297 | OTL_nm1 | cg07728874 | CD3D | NM_000732.3 | 00167286 | 0.87 | 0.91 | 0.14 | 0.11 | 0.91 | 0.87 | 0.21 | 593/594 |
| 298 | OTL_nm2 | cg24841244 | CD3D | NM_000732.3 | 00167286 | 0.83 | 0.84 | 0.10 | 0.07 | 0.86 | 0.80 | 0.16 | 595/596 |
| 299 | OTL_nm3 | cg15880738 | CD3G | NM_000073.1 | 00160654 | 0.87 | 0.88 | 0.07 | 0.06 | 0.88 | 0.84 | 0.12 | 597/598 |
| 300 | OTL_nm4 | cg07545925 | CD3G | NM_000073.1 | 00160654 | 0.78 | 0.76 | 0.22 | 0.32 | 0.66 | 0.66 | 0.23 | 599/600 |
| 301 | OTL_nm05 | cg24612198 | CD3E | NM_000733.2 | 00198851 | 0.74 | 0.79 | 0.10 | 0.14 | 0.63 | 0.60 | 0.11 | 601/602 |
| 302 | OTL_nm06 | cg04759756 | SLA2 | NM_032214.2 | 00101082 | 0.91 | 0.91 | 0.21 | 0.12 | 0.91 | 0.73 | 0.20 | 603/604 |
| 303 | OTL_nm07 | cg08539991 | ZBTB32 | NM_014383.1 | 00011590 | 0.84 | 0.89 | 0.18 | 0.19 | 0.58 | 0.75 | 0.17 | 605/606 |
| 304 | OTL_nm08 | cg18350391 | IL32 | NM_001012631.1 | 00008517 | 0.82 | 0.87 | 0.15 | 0.13 | 0.82 | 0.68 | 0.18 | 607/608 |
| 305 | OTL_nm09 | cg19812619 | ITGB7 | NM_000889.1 | 00139626 | 0.90 | 0.90 | 0.29 | 0.25 | 0.63 | 0.71 | 0.28 | 609/610 |
| 306 | OTL_nm10 | cg20366831 | APBA3 | NM_004886.3 | 00011132 | 0.68 | 0.81 | 0.20 | 0.21 | 0.74 | 0.65 | 0.24 | 611/612 |
| 307 | OTL_nm11 | cg22670733 | CHRNA3 | NM_000743.2 | 00080644 | 0.78 | 0.82 | 0.22 | 0.22 | 0.82 | 0.80 | 0.45 | 613/614 |
| 308 | OTL_nm12 | cg16173109 | FLJ38379 | XR_001026.1 | 00204098 | 0.87 | 0.86 | 0.11 | 0.28 | 0.72 | 0.72 | 0.53 | 615/616 |
| 309 | OTL_nm13 | cg00620024 | PPP6C | NM_002721.3 | 00119414 | 0.86 | 0.85 | 0.18 | 0.28 | 0.69 | 0.74 | 0.44 | 617/618 |
| 310 | OTL_nm14 | cg15503752 | ST6GALNAC1 | NM_018414.2 | 00070526 | 0.75 | 0.74 | 0.13 | 0.25 | 0.59 | 0.66 | 0.17 | 619/620 |
| 311 | OTL_nm15 | cg15055101 | SH2D3A | NM_005490.1 | 00125731 | 0.77 | 0.82 | 0.19 | 0.34 | 0.72 | 0.70 | 0.48 | 621/622 |
| 312 | OTL_nm16 | cg18149207 | RORC | NM_005060.3 | 00143365 | 0.85 | 0.87 | 0.52 | 0.24 | 0.75 | 0.74 | 0.58 | 623/624 |
| 313 | OTL_nm17 | cg16854606 | DAND5 | NM_152654.2 | 00179284 | 0.66 | 0.77 | 0.34 | 0.31 | 0.79 | 0.65 | 0.27 | 625/626 |
| 314 | OTL_m1 | cg24091474 | TYROBP | NM_003332.2 | 00011600 | 0.12 | 0.08 | 0.84 | 0.84 | 0.27 | 0.10 | 0.60 | 627/628 |
| 315 | OTL_m2 | cg25957124 | DNAH3 | NM_017539.1 | 00158486 | 0.05 | 0.04 | 0.82 | 0.82 | 0.05 | 0.31 | 0.86 | 629/630 |
| 316 | OTL_m3 | cg01526089 | P2RX1 | NM_002558.2 | 00108405 | 0.03 | 0.04 | 0.86 | 0.84 | 0.52 | 0.25 | 0.85 | 631/632 |
| 317 | OTL_m4 | cg12971694 | CD72 | NM_001782.1 | 00137101 | 0.11 | 0.08 | 0.80 | 0.77 | 0.09 | 0.21 | 0.67 | 633/634 |
| 318 | OTL_m5 | cg19906550 | SLC22A18 | NM_183233.1 | 00110628 | 0.03 | 0.04 | 0.72 | 0.78 | 0.32 | 0.24 | 0.63 | 635/636 |
| 319 | OTL_m6 | cg17468997 | NCF1 | NM_000265.1 | 00158517 | 0.12 | 0.10 | 0.79 | 0.82 | 0.06 | 0.38 | 0.81 | 637/638 |
| 320 | OTL_m7 | cg19399532 | FLJ35530 | NM_207467.1 | 00204092 | 0.07 | 0.06 | 0.70 | 0.80 | 0.06 | 0.39 | 0.79 | 639/640 |
| 321 | OTL_m8 | cg09208010 | MMP14 | NM_004995.2 | 00157227 | 0.09 | 0.08 | 0.80 | 0.80 | 0.36 | 0.28 | 0.82 | 641/642 |
| 322 | OTL_m9 | cg15512851 | FGD2 | NM_173558.2 | 00146192 | 0.12 | 0.08 | 0.76 | 0.73 | 0.08 | 0.20 | 0.64 | 643/644 |
| 323 | OTL_m10 | cg20191453 | AMT | NM_000481.2 | 00145020 | 0.16 | 0.17 | 0.87 | 0.85 | 0.51 | 0.25 | 0.89 | 645/646 |
| 324 | OTL_m11 | cg24453664 | CD59 | NM_203331.1 | 00085063 | 0.07 | 0.10 | 0.79 | 0.79 | 0.37 | 0.29 | 0.82 | 647/648 |
| 325 | OTL_m12 | cg10257049 | C5orf4 | NM_032385.1 | 00170271 | 0.07 | 0.07 | 0.75 | 0.75 | 0.28 | 0.21 | 0.74 | 649/650 |
| 326 | OTL_m13 | cg16003913 | MPG | NM_001015052.1 | 00103152 | 0.05 | 0.15 | 0.82 | 0.81 | 0.41 | 0.32 | 0.82 | 651/652 |
| 327 | OTL_m14 | cg14088811 | SPI1 | NM_003120.1 | 00066336 | 0.10 | 0.07 | 0.77 | 0.74 | 0.08 | 0.41 | 0.79 | 653/654 |
| 328 | OTL_m15 | cg15146752 | EPHA2 | NM_004431.2 | 00142627 | 0.26 | 0.27 | 0.90 | 0.86 | 0.41 | 0.35 | 0.87 | 655/656 |
| 329 | OTL_m16 | cg02082571 | CLEC4A | NM_016184.2 | 00111729 | 0.23 | 0.14 | 0.85 | 0.87 | 0.44 | 0.47 | 0.83 | 657/658 |
| 330 | OTL_m17 | cg16989646 | SLC25A15 | NM_014252.1 | 00102743 | 0.04 | 0.07 | 0.69 | 0.59 | 0.04 | 0.11 | 0.54 | 659/660 |
| 331 | OTL_m18 | cg03574571 | CD22 | NM_001771.1 | 00012124 | 0.12 | 0.09 | 0.85 | 0.75 | 0.21 | 0.49 | 0.75 | 661/662 |
| 332 | OTL_m19 | cg13703437 | FYB | NM_199335.2 | 00082074 | 0.12 | 0.13 | 0.86 | 0.81 | 0.36 | 0.45 | 0.84 | 663/664 |
| 333 | OTL_m20 | cg21237418 | RAB34 | NM_031934.3 | 00109743 | 0.04 | 0.04 | 0.69 | 0.61 | 0.09 | 0.18 | 0.75 | 665/666 |
| 334 | OTL_m21 | cg01129847 | C19orf35 | NM_198532.1 | 00188305 | 0.08 | 0.12 | 0.69 | 0.62 | 0.18 | 0.06 | 0.53 | 667/668 |
| 335 | OTL_m22 | cg16139316 | S100A9 | NM_002965.2 | 00163220 | 0.06 | 0.07 | 0.84 | 0.73 | 0.49 | 0.37 | 0.85 | 669/670 |
| 336 | OTL_m23 | cg00666746 | SYDE1 | NM_033025.4 | 00105137 | 0.08 | 0.07 | 0.71 | 0.58 | 0.18 | 0.11 | 0.58 | 671/672 |
| 337 | OTL_m24 | cg20050826 | K6IRS2 | NM_080747.1 | 00170486 | 0.14 | 0.18 | 0.77 | 0.69 | 0.19 | 0.27 | 0.59 | 673/674 |
| 338 | OTL_m25 | cg12876594 | NPR2 | NM_000907.2 | 00139626 | 0.23 | 0.19 | 0.79 | 0.76 | 0.31 | 0.26 | 0.77 | 675/676 |
| 339 | OTL_m26 | cg17105014 | GYPC | NM_002101.3 | 00136732 | 0.13 | 0.14 | 0.76 | 0.70 | 0.35 | 0.26 | 0.68 | 677/678 |
| 340 | OTL_m27 | cg03886110 | PECAM1 | NM_000442.2 | 00261371 | 0.05 | 0.07 | 0.77 | 0.50 | 0.35 | 0.09 | 0.47 | 679/680 |
| 341 | OTL_m28 | cg14324675 | LST1 | NM_205838.1 | 00204482 | 0.05 | 0.04 | 0.63 | 0.71 | 0.24 | 0.36 | 0.65 | 681/682 |
| 342 | OTL_m29 | cg08519905 | CD9 | NM_001769.2 | 00010278 | 0.10 | 0.12 | 0.71 | 0.61 | 0.11 | 0.35 | 0.68 | 683/684 |

TABLE 4A

Natural Killer Cells - Markers

| Marker-ID | TargetID | SYMBOL | Accession | Basophil Granulocytes | Eosinophil Granulocytes | Neutrophil Granulocytes | Classical Monocytes | Non-classical Monocytes | NK classical |
|---|---|---|---|---|---|---|---|---|---|
| NK_nm33 | cg24433034 | — | — | 0.97 | 0.97 | 0.97 | 0.97 | 0.95 | 0.09 |
| NK_nm34 | cg27274718 | ANKRD28 | NM_015199 | 0.92 | 0.89 | 0.91 | 0.91 | 0.87 | 0.08 |

TABLE 4A-continued

Natural Killer Cells - Markers

| Marker-ID | | | | | | | |
|---|---|---|---|---|---|---|---|
| NK_nm35 | cg07802362 | DNM3 | NM_015569 | 0.90 | 0.91 | 0.92 | 0.92 | 0.90 | 0.12 |
| NK_nm36 | cg13292607 | CTBP2 | NM_001083914 | 0.95 | 0.91 | 0.92 | 0.93 | 0.92 | 0.16 |
| NK_nm37 | cg04064701 | RHOBTB1 | NM_014836 | 0.91 | 0.90 | 0.93 | 0.93 | 0.91 | 0.16 |
| NK_nm9 | cg03368758 | LDB2 | NM_001290 | 0.90 | 0.85 | 0.88 | 0.88 | 0.86 | 0.16 |
| NK_nm39 | cg17893934 | LARP4B | NM_015155 | 0.97 | 0.96 | 0.96 | 0.96 | 0.96 | 0.22 |
| NK_nm40 | cg16360310 | CXXC5 | NM_016463 | 0.87 | 0.82 | 0.85 | 0.87 | 0.84 | 0.15 |
| NK_nm41 | cg23549472 | RNF165 | NM_152470 | 0.85 | 0.86 | 0.87 | 0.88 | 0.88 | 0.18 |
| NK_nm42 | cg13620110 | EIF3G | NM_003755 | 0.94 | 0.91 | 0.92 | 0.92 | 0.93 | 0.27 |
| NK_nm43 | cg23060465 | EIF2C2 | NM_012154 | 0.97 | 0.97 | 0.97 | 0.97 | 0.96 | 0.33 |
| NK_nm44 | cg21275838 | MYO1E | NM_004998 | 0.88 | 0.90 | 0.89 | 0.89 | 0.89 | 0.27 |
| NK_nm45 | cg15259233 | FAM120B | NM_032448 | 0.88 | 0.86 | 0.88 | 0.89 | 0.87 | 0.30 |
| NK_nm46 | cg11790417 | — | — | 0.88 | 0.90 | 0.88 | 0.89 | 0.89 | 0.31 |
| NK_nm47 | cg06068163 | EIF3B | NM_001037283 | 0.89 | 0.87 | 0.90 | 0.90 | 0.87 | 0.33 |
| NK_nm48 | cg14259466 | ADAM8 | NM_001109 | 0.89 | 0.71 | 0.96 | 0.96 | 0.93 | 0.17 |
| NK_nm49 | cg10592926 | ZDHHC14 | NM_153746 | 0.90 | 0.94 | 0.95 | 0.95 | 0.92 | 0.22 |
| NK_nm50 | cg05253716 | SLC15A4 | NM_145648 | 0.91 | 0.91 | 0.92 | 0.93 | 0.89 | 0.22 |
| NK_nm51 | cg17162797 | RASA3 | NM_007368 | 0.92 | 0.91 | 0.92 | 0.94 | 0.92 | 0.31 |
| NK_nm52 | cg00462849 | — | — | 0.94 | 0.94 | 0.95 | 0.94 | 0.92 | 0.35 |
| NK_nm53 | cg10055950 | C1GALT1 | NM_020156 | 0.91 | 0.92 | 0.92 | 0.91 | 0.89 | 0.13 |
| NK_nm54 | cg19915997 | COLQ | NM_080538 | 0.86 | 0.87 | 0.88 | 0.88 | 0.87 | 0.07 |
| NK_nm55 | cg06706159 | MAST3 | NM_015016 | 0.97 | 0.97 | 0.98 | 0.97 | 0.94 | 0.19 |
| NK_nm56 | cg23015664 | MAD1L1 | NM_003550 | 0.92 | 0.94 | 0.96 | 0.94 | 0.94 | 0.04 |
| NK_nm57 | cg21828319 | RFC2 | NM_181471 | 0.69 | 0.92 | 0.92 | 0.91 | 0.90 | 0.08 |
| NK_nm58 | cg05421487 | AKAP10 | NM_007202 | 0.75 | 0.85 | 0.90 | 0.90 | 0.89 | 0.21 |
| NK_nm59 | cg24467387 | SBNO2 | NM_014963 | 0.84 | 0.91 | 0.93 | 0.92 | 0.88 | 0.23 |
| NKT_nm21 | cg05585475 | — | — | 0.89 | 0.86 | 0.89 | 0.90 | 0.90 | 0.83 |
| NKT_nm22 | cg20063728 | PDGFA | NM_002607 | 0.91 | 0.89 | 0.89 | 0.91 | 0.90 | 0.85 |
| NKT_nm23 | cg00879541 | C14orf166 | NM_016039 | 0.91 | 0.90 | 0.89 | 0.90 | 0.84 | 0.87 |
| NKT_nm24 | cg26215982 | — | — | 0.92 | 0.91 | 0.90 | 0.90 | 0.91 | 0.83 |
| NKT_nm25 | cg08455089 | TBC1D22B | NM_017772 | 0.85 | 0.84 | 0.90 | 0.88 | 0.84 | 0.86 |
| NKT_nm26 | cg09046550 | — | — | 0.87 | 0.89 | 0.87 | 0.89 | 0.88 | 0.83 |
| NKT_nm27 | cg27316453 | LDHAL6A | NM_001144071 | 0.89 | 0.90 | 0.90 | 0.88 | 0.86 | 0.80 |
| NKT_nm28 | cg03069731 | ST7 | NM_018412 | 0.90 | 0.86 | 0.86 | 0.87 | 0.87 | 0.84 |
| NKT_nm29 | cg23642827 | — | — | 0.89 | 0.92 | 0.90 | 0.91 | 0.90 | 0.82 |
| NKT_nm30 | cg12219570 | ZAK | NM_016653 | 0.88 | 0.87 | 0.91 | 0.93 | 0.91 | 0.83 |
| NKT_nm31 | cg16548262 | — | — | 0.89 | 0.79 | 0.80 | 0.84 | 0.84 | 0.79 |
| NKT_nm32 | cg05844859 | NCRNA00119 | NR_002811 | 0.87 | 0.90 | 0.88 | 0.87 | 0.87 | 0.82 |
| NKT_nm33 | cg15740507 | TBC1D23 | NM_018309 | 0.88 | 0.79 | 0.86 | 0.82 | 0.76 | 0.77 |
| NKT_nm34 | cg07406728 | — | — | 0.84 | 0.85 | 0.89 | 0.87 | 0.83 | 0.83 |
| NKT_nm35 | cg13994599 | SAMD4A | NM_001161577 | 0.82 | 0.80 | 0.81 | 0.81 | 0.82 | 0.81 |
| NKT_nm36 | cg03345391 | GCK | NM_000162 | 0.84 | 0.86 | 0.87 | 0.82 | 0.83 | 0.82 |
| NKT_nm37 | cg07891862 | PTK2 | NM_153831 | 0.91 | 0.91 | 0.90 | 0.91 | 0.87 | 0.84 |
| NKT_nm38 | cg25503323 | AOAH | NM_001637 | 0.87 | 0.88 | 0.84 | 0.88 | 0.89 | 0.83 |
| NKT_nm39 | cg24037746 | C3orf30 | NM_152539 | 0.90 | 0.90 | 0.90 | 0.88 | 0.87 | 0.73 |
| NKT_nm40 | cg13382516 | SGMS1 | NM_147156 | 0.88 | 0.86 | 0.89 | 0.89 | 0.89 | 0.79 |
| NKT_nm41 | cg25918166 | — | — | 0.85 | 0.84 | 0.85 | 0.84 | 0.83 | 0.80 |
| NKT_nm42 | cg08250738 | — | — | 0.90 | 0.92 | 0.92 | 0.93 | 0.93 | 0.86 |
| NKT_nm43 | cg19083007 | RCAN2 | NM_005822 | 0.86 | 0.85 | 0.86 | 0.87 | 0.85 | 0.84 |
| NKT_nm44 | cg06228763 | ELFN1 | NM_001128636 | 0.80 | 0.76 | 0.77 | 0.80 | 0.78 | 0.75 |
| NKT_nm45 | cg19243780 | UBE2E2 | NM_152653 | 0.82 | 0.82 | 0.85 | 0.89 | 0.84 | 0.83 |
| NKT_nm46 | cg11571124 | CLIP1 | NM_002956 | 0.89 | 0.88 | 0.90 | 0.89 | 0.88 | 0.72 |
| NKT_nm47 | cg17569413 | — | — | 0.89 | 0.88 | 0.89 | 0.88 | 0.89 | 0.90 |
| NKT_nm48 | cg14089425 | KCNQ1 | NM_000218 | 0.86 | 0.87 | 0.89 | 0.90 | 0.86 | 0.80 |
| NKT_nm49 | cg26894807 | GPR89A | NM_001097613 | 0.85 | 0.89 | 0.89 | 0.89 | 0.90 | 0.85 |
| NKT_nm50 | cg02791542 | OSBPL10 | NM_017784 | 0.86 | 0.86 | 0.85 | 0.86 | 0.84 | 0.77 |
| NKT_nm51 | cg24585690 | IL9 | NM_000590 | 0.86 | 0.85 | 0.87 | 0.87 | 0.87 | 0.85 |
| NKT_nm52 | cg18904552 | TNKS2 | NM_025235 | 0.87 | 0.82 | 0.89 | 0.90 | 0.89 | 0.88 |
| NKT_nm53 | cg18077068 | — | — | 0.88 | 0.87 | 0.89 | 0.85 | 0.86 | 0.84 |
| NKT_nm54 | cg03905757 | KCNQ1 | NM_000218 | 0.83 | 0.86 | 0.86 | 0.85 | 0.84 | 0.77 |
| NKT_nm55 | cg12630243 | — | — | 0.91 | 0.86 | 0.88 | 0.91 | 0.91 | 0.84 |
| NKT_nm56 | cg12399350 | — | — | 0.83 | 0.80 | 0.81 | 0.86 | 0.86 | 0.73 |
| NKT_nm57 | cg00829600 | — | — | 0.86 | 0.83 | 0.79 | 0.87 | 0.88 | 0.79 |
| NKT_nm58 | cg24722886 | PLEKHA7 | NM_175058 | 0.86 | 0.81 | 0.84 | 0.83 | 0.85 | 0.75 |
| NKT_nm59 | cg16565562 | — | — | 0.87 | 0.83 | 0.84 | 0.87 | 0.86 | 0.81 |
| NKT_nm60 | cg13362028 | — | — | 0.79 | 0.78 | 0.76 | 0.76 | 0.77 | 0.74 |

| Marker-ID | B-Cells | CD4+ Th naive | CD4+ Th1 | CD4+ Th2 | CD4+ Th Central Mem. | CD4+ Th Effect. Mem. | CD8+ Cytotoxic T-Cells | NK T-Cells | Discovery Fragment |
|---|---|---|---|---|---|---|---|---|---|
| NK_nm33 | 0.97 | 0.97 | 0.97 | 0.97 | 0.96 | 0.95 | 0.93 | 0.80 | CGCTCCCCAAGTGCTGACCACGCGCGCCCCCACGGCTCCCCGACAGCTCC (SEQ ID NO: 696) |

TABLE 4A-continued

Natural Killer Cells - Markers

| | | | | | | | | | |
|---|---|---|---|---|---|---|---|---|---|
| NK_nm34 | 0.90 | 0.92 | 0.90 | 0.91 | 0.91 | 0.92 | 0.89 | 0.87 | AGTAGGTAAAAACACTG ATGCACTCTGCTTACCA TGTAAGCCTCTTAACG (SEQ ID NO: 697) |
| NK_nm35 | 0.90 | 0.91 | 0.86 | 0.87 | 0.90 | 0.90 | 0.83 | 0.83 | CGGCTCCAAATCAAAAG CTGTGGAAGGAGGTAAT TAGCAGGGACTCTAGA (SEQ ID NO: 698) |
| NK_nm36 | 0.93 | 0.94 | 0.89 | 0.89 | 0.91 | 0.91 | 0.87 | 0.85 | TTTTGTTGGTTCCTCAC GTGGGCAGAAGAGTGAA TGCTCAGTCCCCATCG (SEQ ID NO: 699) |
| NK_nm37 | 0.92 | 0.91 | 0.91 | 0.92 | 0.91 | 0.91 | 0.89 | 0.84 | AGCTGATACTGCGTGAG TGTGGTGTTGCACGCCC TGGCACAGATCAAGCG (SEQ ID NO: 700) |
| NK_nm9 | 0.88 | 0.89 | 0.93 | 0.91 | 0.93 | 0.93 | 0.91 | 0.90 | CCCTTCACAACCTGATT GCTAAGCTTGTTAGCAT AGAGGTGGTCTAACCG (SEQ ID NO: 701) |
| NK_nm39 | 0.97 | 0.97 | 0.95 | 0.96 | 0.96 | 0.96 | 0.93 | 0.87 | AAAACCGTACGTCTGGG AGGGGTCGCAGAGCGCT GTGTTAACCACAAACG (SEQ ID NO: 702) |
| NK_nm40 | 0.86 | 0.85 | 0.86 | 0.87 | 0.86 | 0.86 | 0.87 | 0.84 | CCATTACCACTGGCTTT GTTACAATCTATTACAA CAATAGCAGTTGGCCG (SEQ ID NO: 703) |
| NK_nm41 | 0.92 | 0.84 | 0.86 | 0.85 | 0.87 | 0.86 | 0.83 | 0.84 | CGGAAGGGCAACAGAAC AAAAGCAGCGTACAATG AGCAGATGGCCCGGGC (SEQ ID NO: 704) |
| NK_nm42 | 0.94 | 0.94 | 0.91 | 0.90 | 0.95 | 0.94 | 0.93 | 0.87 | GGGGATAATTACGAGGT GCCGGGAGGTGCCCACC CACCAGCCTGGCGTCG (SEQ ID NO: 705) |
| NK_nm43 | 0.97 | 0.97 | 0.97 | 0.97 | 0.97 | 0.97 | 0.94 | 0.93 | CAGAGGGCTCTGAGCGG GCTGTGTGCCGGGCGAG AACACTGCCTGGGCCG (SEQ ID NO: 706) |
| NK_nm44 | 0.86 | 0.88 | 0.90 | 0.90 | 0.90 | 0.89 | 0.90 | 0.87 | CGCAGCTTATTTGTCAC TGAGAAAGTTCAAGTTA GTGCTCTAATTCCACC (SEQ ID NO: 707) |
| NK_nm45 | 0.89 | 0.89 | 0.87 | 0.86 | 0.87 | 0.89 | 0.90 | 0.85 | CGGGGCAGCTGCCTGCA CTGAGCTCTGAGGCCTT TGAAGTGGACCAGAGA (SEQ ID NO: 708) |
| NK_nm46 | 0.88 | 0.88 | 0.85 | 0.87 | 0.89 | 0.87 | 0.89 | 0.85 | TTAAGGGCCAACCCTGA CCACAGCTGAGCCGTGT GAAGAGGCTGACAGCG (SEQ ID NO: 709) |
| NK_nm47 | 0.89 | 0.90 | 0.87 | 0.86 | 0.87 | 0.89 | 0.89 | 0.88 | CGGCTACAAGCTTGACA AGCAGCACACATTCCGG GTCAACCTCTTTACGG (SEQ ID NO: 710) |
| NK_nm48 | 0.93 | 0.87 | 0.96 | 0.96 | 0.96 | 0.96 | 0.96 | 0.92 | CGGCGTCTCCAGGCCTG CGGCCAAGCGTGCTTGC CCTTGGTGACCACATT (SEQ ID NO: 711) |

TABLE 4A-continued

Natural Killer Cells - Markers

| | | | | | | | | | |
|---|---|---|---|---|---|---|---|---|---|
| NK_nm49 | 0.93 | 0.86 | 0.91 | 0.92 | 0.94 | 0.93 | 0.91 | 0.92 | GGCGCTCTGCCTGCAGC TATCTCCGTGTCAATGG CATCCTTTGATAGTCG (SEQ ID NO: 712) |
| NK_nm50 | 0.91 | 0.92 | 0.91 | 0.91 | 0.91 | 0.92 | 0.91 | 0.79 | CGCCAGAGTAATGGGTA AGCACTTAGTTCTCATC TTGGGCTGTTTGAAAG (SEQ ID NO: 713) |
| NK_nm51 | 0.91 | 0.92 | 0.91 | 0.93 | 0.92 | 0.92 | 0.93 | 0.91 | CGCTAAACGGTGCCACA GTTTTACTCTCTTGGAA CTGTCCCACATGGGTT (SEQ ID NO: 714) |
| NK_nm52 | 0.94 | 0.95 | 0.93 | 0.92 | 0.94 | 0.94 | 0.95 | 0.92 | CGAGGCATCGGCCCGTT TTGTGTCTGGTAAGGGC CAGAGTCCTGGTTCAT (SEQ ID NO: 715) |
| NK_nm53 | 0.90 | 0.92 | 0.92 | 0.92 | 0.93 | 0.89 | 0.91 | 0.81 | CGCTCACTGCTTACTTA AATGGACAGTTTTAAGT TTCAGTTTTAAGCTCA (SEQ ID NO: 716) |
| NK_nm54 | 0.87 | 0.86 | 0.81 | 0.82 | 0.85 | 0.83 | 0.82 | 0.73 | CGTGCAGGCATTCTCAC TCACACTGGGCAGCCCG CTGTCGGGTCTCTCTA (SEQ ID NO: 717) |
| NK_nm55 | 0.98 | 0.98 | 0.98 | 0.98 | 0.98 | 0.98 | 0.88 | 0.70 | CGAGCTCGGCCTCTGGC CCACGAGTGCGCCGCCC CGCCTCCCCATCCAGC (SEQ ID NO: 718) |
| NK_nm56 | 0.95 | 0.93 | 0.95 | 0.95 | 0.94 | 0.96 | 0.92 | 0.80 | CGCGGACCCCGCTTCTG TCACCCCTAACCTCACT GTTGGGTCCGGGACCT (SEQ ID NO: 719) |
| NK_nm57 | 0.74 | 0.67 | 0.91 | 0.92 | 0.92 | 0.92 | 0.90 | 0.84 | CGGGGCACAGACGTCCC AGAAGCAAACATGCAA GTCACGGGAGTTTATTT (SEQ ID NO: 720) |
| NK_nm58 | 0.90 | 0.76 | 0.86 | 0.88 | 0.89 | 0.90 | 0.85 | 0.83 | TCTATATCTGATCCATC AGCAAATCTGTTAGGTC TACCTCACACATATCG (SEQ ID NO: 721) |
| NK_nm59 | 0.91 | 0.83 | 0.88 | 0.90 | 0.93 | 0.90 | 0.88 | 0.82 | GTGGGTCTCACTCAGCT GGGCGCTGGGGCCCTGG TGGAGAATGGCTGTCG (SEQ ID NO: 722) |
| NKT_nm21 | 0.81 | 0.90 | 0.81 | 0.83 | 0.86 | 0.86 | 0.67 | 0.27 | CGGTAGACAAATGATAG ACATTTGTTGAATCAAG CTGTGAGTTGGAGATC (SEQ ID NO: 723) |
| NKT_nm22 | 0.89 | 0.90 | 0.69 | 0.85 | 0.82 | 0.79 | 0.63 | 0.13 | GTCTTTGCCTGACACCT TCTGTGAGGTTTGCGGG CTTCATTTTAAATCCG (SEQ ID NO: 724) |
| NKT_nm23 | 0.84 | 0.87 | 0.72 | 0.80 | 0.81 | 0.77 | 0.70 | 0.17 | GGGGTTATATATTTTTG ACCAAATTCACCATTAC TCATTTGGCATTTTCG (SEQ ID NO: 725) |
| NKT_nm24 | 0.81 | 0.89 | 0.59 | 0.70 | 0.74 | 0.67 | 0.59 | 0.15 | GCGTACACACCCTGATA AGGTGTCAAGAACCTCC GTTTGAGTACCCCTCG (SEQ ID NO: 726) |

TABLE 4A-continued

Natural Killer Cells - Markers

| | | | | | | | | | |
|---|---|---|---|---|---|---|---|---|---|
| NKT_nm25 | 0.81 | 0.84 | 0.51 | 0.62 | 0.61 | 0.48 | 0.60 | 0.15 | CCTGCTGTAGATGTGTC ACAGCTAAAITCTTGAA TGGATTTTTATCATCG (SEQ ID NO: 727) |
| NKT_nm26 | 0.87 | 0.88 | 0.51 | 0.70 | 0.63 | 0.60 | 0.69 | 0.22 | GAACCAAGCACTGCTTC CTGGGAGAGTGATGTCA GCATGACTCAAAGGCG (SEQ ID NO: 728) |
| NKT_nm27 | 0.82 | 0.91 | 0.55 | 0.65 | 0.68 | 0.60 | 0.69 | 0.23 | CGCAAACCCACCCTCTA TCCGGGTGAGCACCATC TAGTCAGCTGCCAGCA (SEQ ID NO: 729) |
| NKT_nm28 | 0.82 | 0.87 | 0.56 | 0.70 | 0.67 | 0.61 | 0.68 | 0.24 | CGTGGGATCTCTGTTCA TTTTGGTATATTACTTT GCTTTCTGGGCTGAGC (SEQ ID NO: 730) |
| NKT_nm29 | 0.80 | 0.91 | 0.60 | 0.79 | 0.77 | 0.74 | 0.59 | 0.26 | CGCATACTTTCAGGGAG AGGCACTATTCTTGGCT TTAAGTTCATGAGTAA (SEQ ID NO: 731) |
| NKT_nm30 | 0.82 | 0.88 | 0.57 | 0.61 | 0.67 | 0.60 | 0.68 | 0.25 | CGGGGGGAGAATTAAG CCAAAGAAGTATATTTA TGAATCAGCAAATGTGG (SEQ ID NO: 732) |
| NKT_nm31 | 0.82 | 0.90 | 0.61 | 0.79 | 0.71 | 0.71 | 0.68 | 0.24 | CGGCTTGAACCCTCAGC TTCTACAGTTGTGTCAC CCATGTGTCTGTTTCT (SEQ ID NO: 733) |
| NKT_nm32 | 0.80 | 0.86 | 0.55 | 0.54 | 0.66 | 0.59 | 0.68 | 0.24 | GGCCGAGGTGAAACCAT TGGTTTTTAACCTTGAC TACTGATTAAAATCCG (SEQ ID NO: 734) |
| NKT_nm33 | 0.80 | 0.88 | 0.59 | 0.74 | 0.68 | 0.61 | 0.66 | 0.24 | ATCAGCACCAAAGCTTT GTCTGAACTTATTTTGC TACTATTGTTAGGACG (SEQ ID NO: 735) |
| NKT_nm34 | 0.86 | 0.85 | 0.57 | 0.67 | 0.68 | 0.64 | 0.68 | 0.27 | CGACTGTGGGGAATGAA TAAGATTACAATAAAAC CTGAGGAATTTAATGC (SEQ ID NO: 736) |
| NKT_nm35 | 0.80 | 0.87 | 0.54 | 0.57 | 0.66 | 0.62 | 0.67 | 0.26 | CGAGTGAGTCCAAACTC CTTAGAAAGTTGGTTGC TAAGGACTTGGAAAAG (SEQ ID NO: 737) |
| NKT_nm36 | 0.80 | 0.85 | 0.57 | 0.58 | 0.70 | 0.61 | 0.69 | 0.28 | CCCTTCCCCAAGTTCCA TACAGACCCCTGGATTG TATGAAATGCAAATCG (SEQ ID NO: 738) |
| NKT_nm37 | 0.81 | 0.88 | 0.58 | 0.67 | 0.72 | 0.62 | 0.66 | 0.14 | CGGAGAGCAAACAGGGC TAACACAGAAAGCCCTT GTAAAAAACAGAACGA (SEQ ID NO: 739) |
| NKT_nm38 | 0.87 | 0.88 | 0.50 | 0.61 | 0.67 | 0.60 | 0.61 | 0.15 | CGAGGAAGGTATGGTAG AAATGCATCCATTACCA AGAAGAAAAGTAATCT (SEQ ID NO: 740) |
| NKT_nm39 | 0.83 | 0.89 | 0.60 | 0.76 | 0.75 | 0.71 | 0.66 | 0.20 | CACATCACTATATGGAA CACGACTATACTTTCAA AAGATGACCAATCTCG (SEQ ID NO: 741) |

TABLE 4A-continued

Natural Killer Cells - Markers

| | | | | | | | | | |
|---|---|---|---|---|---|---|---|---|---|
| NKT_nm40 | 0.75 | 0.88 | 0.67 | 0.74 | 0.72 | 0.69 | 0.61 | 0.20 | CGTGCCCAGCTTTTCTA<br>TGGGAAAAATTGTTCTT<br>CAGACAGAGCATGAAT<br>(SEQ ID NO: 742) |
| NKT_nm41 | 0.78 | 0.84 | 0.48 | 0.60 | 0.68 | 0.59 | 0.58 | 0.17 | CGTCATTATCTGGCAAT<br>AGTTGTTGGATGTGTTT<br>GCTGCCATGCCACGAG<br>(SEQ ID NO: 743) |
| NKT_nm42 | 0.78 | 0.89 | 0.62 | 0.70 | 0.71 | 0.68 | 0.63 | 0.26 | CGTAGGTTTCCAAGAAA<br>GATAGGGTGACAAATT<br>GCCTGTCACTCCGATT<br>(SEQ ID NO: 744) |
| NKT_nm43 | 0.77 | 0.87 | 0.49 | 0.59 | 0.64 | 0.60 | 0.65 | 0.21 | CGGATTTCTATTCAGCC<br>CATGCCCGGGATGCATT<br>AGGATGCCCAGAACAT<br>(SEQ ID NO: 745) |
| NKT_nm44 | 0.74 | 0.81 | 0.49 | 0.51 | 0.51 | 0.45 | 0.52 | 0.14 | GGGAGTGGCCCAGCCCG<br>GTTTGCTCAGTGACCAG<br>GATGTTTCCACAGTCG<br>(SEQ ID NO: 746) |
| NKT_nm45 | 0.87 | 0.84 | 0.46 | 0.50 | 0.63 | 0.54 | 0.69 | 0.21 | GTGGTCTGGTTACATCA<br>GCAAACATGTTCTACAA<br>TCAAGGTAAAAACTCG<br>(SEQ ID NO: 747) |
| NKT_nm46 | 0.83 | 0.87 | 0.51 | 0.62 | 0.60 | 0.56 | 0.66 | 0.23 | CGAGTACTAAAAGGTCA<br>AATGTGTCAAGTCTAGA<br>ACTAGTACTCTTTTTT<br>(SEQ ID NO: 748) |
| NKT_nm47 | 0.83 | 0.91 | 0.53 | 0.70 | 0.63 | 0.59 | 0.70 | 0.26 | CGCACCATCACACCGTC<br>AGCAACTTGTGGGACCA<br>ACTCCCTGCACATCTG<br>(SEQ ID NO: 749) |
| NKT_nm48 | 0.76 | 0.85 | 0.57 | 0.70 | 0.75 | 0.70 | 0.70 | 0.25 | AGTACATCTGTTGACAA<br>CATGGTTTACTGAATAT<br>GTTGAGCCCATTTTCG<br>(SEQ ID NO: 750) |
| NKT_nm49 | 0.80 | 0.87 | 0.57 | 0.47 | 0.64 | 0.63 | 0.61 | 0.23 | TCTATCTTCATTTAACT<br>TCCAGTCCTTTGCCCTA<br>CAGATAATTCGTAGCG<br>(SEQ ID NO: 751) |
| NKT_nm50 | 0.82 | 0.87 | 0.49 | 0.53 | 0.61 | 0.56 | 0.61 | 0.21 | CGGCCAAAAGAAAGAC<br>ATAGAATAGAATGGTGG<br>TTGCTGAGGGTTGGAGA<br>(SEQ ID NO: 752) |
| NKT_nm51 | 0.78 | 0.88 | 0.62 | 0.59 | 0.68 | 0.67 | 0.67 | 0.24 | CGGACTGGAGCTCGCTT<br>GCAGACACCTTCAAATC<br>GAGTGGTATITAAAGC<br>(SEQ ID NO: 753) |
| NKT_nm52 | 0.89 | 0.88 | 0.50 | 0.62 | 0.58 | 0.53 | 0.74 | 0.27 | ACAAACAAAAGCTATC<br>TGAAAATGCTGCCATGC<br>TAACAPATGAACCACG<br>(SEQ ID NO: 754) |
| NKT_nm53 | 0.77 | 0.87 | 0.51 | 0.56 | 0.63 | 0.52 | 0.69 | 0.26 | CGAATGGAAATTCAAAG<br>GGAGAACATCTAATGTT<br>CAAGTTGATGTCTATA<br>(SEQ ID NO: 755) |
| NKT_nm54 | 0.79 | 0.84 | 0.58 | 0.66 | 0.73 | 0.68 | 0.62 | 0.26 | CGTCCCCTCTAATACTA<br>TAGCTGAGAGCTTTTAA<br>TATGAATGGGTGTTAA<br>(SEQ ID NO: 756) |

TABLE 4A-continued

Natural Killer Cells - Markers

| | | | | | | | | | |
|---|---|---|---|---|---|---|---|---|---|
| NKT_nm55 | 0.77 | 0.89 | 0.51 | 0.57 | 0.66 | 0.61 | 0.69 | 0.28 | CGACTGGTGTTGATTCT CAGTCAATTTAAAGGAT GAAAAGGGCTGTAAAA (SEQ ID NO: 757) |
| NKT_nm56 | 0.79 | 0.82 | 0.54 | 0.65 | 0.62 | 0.58 | 0.64 | 0.25 | CCCAGTTCTTCAGAGTT GTCAGGGTCACTGCTCT GGGACCCACGGACTCG (SEQ ID NO: 758) |
| NKT_nm57 | 0.84 | 0.84 | 0.49 | 0.55 | 0.60 | 0.55 | 0.61 | 0.26 | CGAAGGAGGGAGTGCA TGAATTCATGTAAGGAT GGAGATCCACATCCCAG (SEQ ID NO: 759) |
| NKT_nm58 | 0.81 | 0.82 | 0.55 | 0.57 | 0.66 | 0.61 | 0.59 | 0.26 | CGAGTGTGGAGCTATGA TTGGAACCTAGTTCAGG CTCCAAAGCCACACTC (SEQ ID NO: 760) |
| NKT_nm59 | 0.76 | 0.85 | 0.48 | 0.52 | 0.64 | 0.59 | 0.67 | 0.28 | CGGATTTTTGAGACAGT TTGGGAATAGTTTATCC TGTTATTATCTTCAGG (SEQ ID NO: 761) |
| NKT_nm60 | 0.73 | 0.73 | 0.47 | 0.51 | 0.55 | 0.44 | 0.61 | 0.24 | CGTTAGGATTGCTAAAG AGCATTTTCTAAATATT TGAGTGTAAACCACTG (SEQ ID NO: 762) |

TABLE 4B

B-Cell Markers

| Marker-ID | TargetID | SYMBOL | Accession | Basophil Granulocytes | Eosinophil Granulocytes | Neutrophil Granulocytes | Classical Monocytes | Non-classical Monocytes | NK classical |
|---|---|---|---|---|---|---|---|---|---|
| B_nm45 | cg22907103 | CYBSC3 | NM_153611 | 0.88 | 0.87 | 0.86 | 0.84 | 0.83 | 0.86 |
| B_nm46 | cg15532942 | NFATC1 | NM_006162 | 0.87 | 0.91 | 0.88 | 0.91 | 0.89 | 0.89 |
| B_nm47 | cg27106643 | NFATC1 | NM_006162 | 0.89 | 0.92 | 0.93 | 0.90 | 0.87 | 0.90 |
| B_nm48 | cg07841371 | TTLL10 | NM_001130045 | 0.92 | 0.94 | 0.94 | 0.95 | 0.92 | 0.95 |
| B_nm49 | cg13738327 | LRP5 | NM_002335 | 0.98 | 0.98 | 0.98 | 0.98 | 0.97 | 0.97 |
| B_nm50 | cg26552743 | — | — | 0.87 | 0.84 | 0.86 | 0.89 | 0.85 | 0.89 |
| B_nm51 | cg05205074 | — | — | 0.92 | 0.92 | 0.93 | 0.92 | 0.88 | 0.91 |
| B_nm52 | cg07721872 | LOC100129637 | NR_024488 | 0.94 | 0.95 | 0.93 | 0.96 | 0.95 | 0.93 |
| B_nm53 | cg11661493 | UBE2O | NM_022066 | 0.90 | 0.88 | 0.89 | 0.90 | 0.87 | 0.91 |
| B_nm54 | cg02212339 | TRPV1 | NM_080704 | 0.98 | 0.97 | 0.97 | 0.97 | 0.96 | 0.97 |
| B_nm55 | cg27564966 | CD19 | NM_001770 | 0.91 | 0.89 | 0.91 | 0.91 | 0.89 | 0.84 |
| B_nm56 | cg25469923 | — | — | 0.85 | 0.86 | 0.87 | 0.86 | 0.83 | 0.82 |
| B_nm57 | cg22498365 | TBCD | NM_005993 | 0.86 | 0.91 | 0.92 | 0.90 | 0.86 | 0.91 |
| B_nm58 | cg17232476 | SORL1 | NM_003105 | 0.89 | 0.90 | 0.89 | 0.86 | 0.83 | 0.89 |
| B_nm59 | cg18664915 | C7orf50 | NM_001134395 | 0.88 | 0.90 | 0.88 | 0.89 | 0.87 | 0.88 |
| B_nm60 | cg20602300 | C15orf57 | NM_052849 | 0.91 | 0.90 | 0.92 | 0.91 | 0.90 | 0.91 |
| B_nm61 | cg18250453 | TERF1 | NM_003218 | 0.89 | 0.85 | 0.90 | 0.91 | 0.90 | 0.82 |
| B_nm62 | cg06889975 | — | — | 0.90 | 0.84 | 0.85 | 0.87 | 0.89 | 0.90 |
| B_nm63 | cg11699517 | BAHCC1 | NM_001080519 | 0.99 | 0.97 | 0.97 | 0.97 | 0.97 | 0.99 |
| B_nm64 | cg15035590 | LRIG1 | NM_015541 | 0.91 | 0.91 | 0.90 | 0.92 | 0.89 | 0.88 |
| B_nm65 | cg15242630 | MICAL3 | NM_001122731 | 0.88 | 0.88 | 0.87 | 0.87 | 0.85 | 0.88 |
| B_nm66 | cg13823257 | — | — | 0.88 | 0.88 | 0.89 | 0.88 | 0.86 | 0.89 |
| B_nm67 | cg13915752 | CDK19 | NM_015076 | 0.88 | 0.85 | 0.90 | 0.90 | 0.90 | 0.91 |
| B_nm68 | cg04838847 | GOLSYN | NM_001099743 | 0.98 | 0.98 | 0.98 | 0.97 | 0.98 | 0.98 |
| B_nm69 | cg22281206 | INPP5J | NM_001002837 | 0.88 | 0.89 | 0.90 | 0.88 | 0.85 | 0.89 |
| B_nm70 | cg19260718 | — | — | 0.87 | 0.90 | 0.89 | 0.90 | 0.86 | 0.89 |
| B_nm71 | cg19766988 | EIF3G | NM_003755 | 0.89 | 0.90 | 0.89 | 0.90 | 0.85 | 0.89 |
| B_nm72 | cg20452738 | ITPKB | NM_002221 | 0.90 | 0.89 | 0.91 | 0.88 | 0.90 | 0.90 |
| B_nm73 | cg26692003 | IQSEC1 | NM_001134382 | 0.95 | 0.96 | 0.97 | 0.95 | 0.91 | 0.96 |
| B_nm74 | cg00762029 | IRF2 | NM_002199 | 0.92 | 0.91 | 0.92 | 0.92 | 0.90 | 0.93 |
| B_nm75 | cg17622855 | ZDHHC14 | NM_153746 | 0.87 | 0.88 | 0.89 | 0.89 | 0.89 | 0.87 |
| B_nm76 | cg04947949 | WDFY4 | NM_020945 | 0.88 | 0.91 | 0.92 | 0.91 | 0.89 | 0.88 |
| B_nm77 | cg25131632 | — | — | 0.96 | 0.97 | 0.97 | 0.97 | 0.96 | 0.96 |
| B_nm78 | cg14482811 | LCN8 | NM_178469 | 0.93 | 0.92 | 0.96 | 0.95 | 0.95 | 0.70 |

TABLE 4B-continued

B-Cell Markers

| | | | | | | | | |
|---|---|---|---|---|---|---|---|---|
| B_nm79 | cg12177944 | PLXND1 | NM_015103 | 0.96 | 0.96 | 0.94 | 0.86 | 0.68 | 0.97 |
| B_nm80 | cg21248060 | C7orf50 | NM_001134395 | 0.96 | 0.96 | 0.97 | 0.97 | 0.95 | 0.95 |
| B_nm81 | cg04828493 | CARS2 | NM_024537 | 0.95 | 0.96 | 0.95 | 0.86 | 0.73 | 0.85 |
| B_nm82 | cg01024458 | RERE | NM_012102 | 0.92 | 0.92 | 0.93 | 0.92 | 0.93 | 0.91 |
| B_nm83 | cg25683989 | HVCN1 | NM_001040107 | 0.92 | 0.77 | 0.92 | 0.92 | 0.91 | 0.89 |
| B_nm84 | cg22212560 | FRMD8 | NM_031904 | 0.89 | 0.86 | 0.90 | 0.72 | 0.62 | 0.93 |
| B_nm85 | cg15348679 | — | — | 0.77 | 0.83 | 0.88 | 0.87 | 0.86 | 0.95 |
| B_nm86 | cg16210395 | CGNL1 | NM_032866 | 0.92 | 0.92 | 0.93 | 0.94 | 0.93 | 0.90 |
| B_nm87 | cg08162476 | IQSEC1 | NM_001134382 | 0.91 | 0.92 | 0.91 | 0.78 | 0.74 | 0.88 |
| B_nm15 | cg07597976 | CD19 | NM_001770 | 0.86 | 0.82 | 0.82 | 0.82 | 0.78 | 0.77 |
| B_nm89 | cg07768103 | RNF44 | NM_014901 | 0.98 | 0.98 | 0.98 | 0.98 | 0.98 | 0.96 |
| B_nm90 | cg13356455 | ATP10A | NM_024490 | 0.91 | 0.89 | 0.90 | 0.90 | 0.90 | 0.88 |
| B_nm91 | cg17995557 | LHPP | NM_022126 | 0.87 | 0.90 | 0.87 | 0.89 | 0.87 | 0.62 |
| B_nm92 | cg17679619 | — | — | 0.90 | 0.85 | 0.89 | 0.89 | 0.88 | 0.88 |
| B_nm93 | cg27304328 | CD84 | NM_003874 | 0.89 | 0.61 | 0.84 | 0.84 | 0.83 | 0.88 |
| B_nm94 | cg26438284 | CD81 | NM_004356 | 0.89 | 0.84 | 0.87 | 0.89 | 0.88 | 0.86 |

| Marker-ID | B-Cells | CD4+ Th naive | CD4+ Th1 | CD4+ Th2 | CD4+ Th Central Mem. | CD4+ Th Effect. Mem. | CD8+ Cytotoxic T-Cells | NK T-Cells | Discovery Fragment |
|---|---|---|---|---|---|---|---|---|---|
| B_nm45 | 0.04 | 0.87 | 0.85 | 0.86 | 0.88 | 0.87 | 0.87 | 0.86 | AGTCATTGTGACTGAAGA TCAGGCCCACCCAGGCAT TGAGGCCTCGGGCG (SEQ ID NO: 763) |
| B_nm46 | 0.07 | 0.87 | 0.86 | 0.85 | 0.83 | 0.84 | 0.88 | 0.85 | CGGCCAGGCCCTCATCCA CCAGAGTAGACCCCAGCA CGAGCAGGCGTCGC (SEQ ID NO: 764) |
| B_nm47 | 0.11 | 0.90 | 0.90 | 0.89 | 0.89 | 0.90 | 0.92 | 0.91 | GCTTTCCACGGCTGTGCGC CTCGGGGCTGGAGCGGCC CCAAGTGAAGACG (SEQ ID NO: 765) |
| B_nm48 | 0.10 | 0.94 | 0.94 | 0.93 | 0.94 | 0.94 | 0.93 | 0.92 | CGCGGCCCAGGGTTCCGC CTGGCTGGCACCACCCCTG GAAGGGCAGCCCC (SEQ ID NO: 766) |
| B_nm49 | 0.03 | 0.97 | 0.93 | 0.96 | 0.97 | 0.96 | 0.95 | 0.88 | CAACGTGAAGAAAACGTG AAATTCTGTCGCTTGTTGC AGCTGACAGCACG (SEQ ID NO: 767) |
| B_nm50 | 0.04 | 0.86 | 0.86 | 0.89 | 0.87 | 0.86 | 0.89 | 0.87 | AAACAGGATCTCTGCAGA TGGAGCTCAGTGTTATGTG TTTTGGATGCTCG (SEQ ID NO: 768) |
| B_nm51 | 0.04 | 0.92 | 0.86 | 0.84 | 0.87 | 0.87 | 0.92 | 0.88 | CGCCCTGGCCTGAAGGGA AGAGTCTACAAGGTTTAT AACCCAGAACCGCA (SEQ ID NO: 769) |
| B_nm52 | 0.03 | 0.93 | 0.94 | 0.94 | 0.91 | 0.93 | 0.94 | 0.93 | CGTCCGCCTCGTCCACTCC TGGCATTTGGGATAAACA TCCTGTCTCAGAC (SEQ ID NO: 770) |
| B_nm53 | 0.04 | 0.89 | 0.89 | 0.90 | 0.91 | 0.89 | 0.89 | 0.89 | CCCTGAAATCGACCCTAA CAATAATAGAGGTTTGGA TTTGCATGAACACG (SEQ ID NO: 771) |
| B_nm54 | 0.05 | 0.97 | 0.95 | 0.95 | 0.97 | 0.96 | 0.96 | 0.95 | CGCCATCGAGAGACGCAA CATGGCCCTGGTGACCCTC CTGGTGGAGAACG (SEQ ID NO: 772) |
| B_nm55 | 0.06 | 0.90 | 0.91 | 0.90 | 0.89 | 0.91 | 0.92 | 0.90 | TTGTGAGTCTGGAGGGTTC CTGGAGAATGGGGCCTGA GGCGTGACCACCG (SEQ ID NO: 773) |
| B_nm56 | 0.06 | 0.89 | 0.85 | 0.87 | 0.84 | 0.85 | 0.87 | 0.84 | CAGGCTACTATTCCTGATG GAGACCCCATTTCCGTGG CGGCCCCTGACG (SEQ ID NO: 774) |
| B_nm57 | 0.07 | 0.88 | 0.89 | 0.91 | 0.89 | 0.91 | 0.89 | 0.91 | TCCTGAAAGTCCCTGGCAC AGGACACCACTACGGGGC TCAGCTGGGTGCG (SEQ ID NO: 775) |

TABLE 4B-continued

B-Cell Markers

| | | | | | | | | | |
|---|---|---|---|---|---|---|---|---|---|
| B_nm58 | 0.07 | 0.89 | 0.87 | 0.88 | 0.89 | 0.88 | 0.88 | 0.88 | CGCAACCAGTATCGCTGC AGCAACGGGAACTGTATC AACAGCATTTGGTG (SEQ ID NO: 776) |
| B_nm59 | 0.07 | 0.90 | 0.86 | 0.88 | 0.88 | 0.87 | 0.87 | 0.84 | CGGGCCAGCCAGGCCATG GCATCTGCCTGCTGGGGG CTGTTTTACTGCTG (SEQ ID NO: 777) |
| B_nm60 | 0.07 | 0.90 | 0.89 | 0.91 | 0.91 | 0.92 | 0.91 | 0.92 | TCCTTCAGTGGATTTCTCC CTGCTGCTGTCACTGAGCT CCACGCTGCTCG (SEQ ID NO: 778) |
| B_nm61 | 0.08 | 0.89 | 0.88 | 0.87 | 0.89 | 0.89 | 0.90 | 0.88 | TTTTTACAAATTGAAAGTT TACCGCAGCCCAGCTTGA GCCAAGTCTAACG (SEQ ID NO: 779) |
| B_nm62 | 0.08 | 0.89 | 0.90 | 0.90 | 0.91 | 0.90 | 0.90 | 0.89 | CTTTATCCAGCAAGAAGC CAGCTGTGTGGCAAGCAA TGGAGGTAAGAACG (SEQ ID NO: 780) |
| B_nm63 | 0.08 | 0.98 | 0.98 | 0.98 | 0.99 | 0.99 | 0.99 | 0.98 | CCCCGTGGGACGTGGGGC AGGCAGCGAGCTTGAGTG TTTGCGCTTCCTCG (SEQ ID NO: 781) |
| B_nm64 | 0.09 | 0.92 | 0.92 | 0.88 | 0.92 | 0.91 | 0.91 | 0.89 | CGGAAAGCCCCATTCACA GGATTTGCATTGATTTGCC CTGATCTAGTTTG (SEQ ID NO: 782) |
| B_nm65 | 0.09 | 0.88 | 0.86 | 0.87 | 0.86 | 0.88 | 0.88 | 0.86 | CGGGGCAGTTTTGTGGCCT TTTGCTATTGAATCTGCCA GATGTGTCCAAG (SEQ ID NO: 783) |
| B_nm66 | 0.09 | 0.88 | 0.85 | 0.87 | 0.88 | 0.88 | 0.89 | 0.84 | AGAGCAAGTCAGGCACAC CATACTCTACCTGGAACA GCTGCTAAACTCCG (SEQ ID NO: 784) |
| B_nm67 | 0.10 | 0.89 | 0.90 | 0.90 | 0.90 | 0.90 | 0.92 | 0.89 | CCCTGACAAAACAAACTC TGTAAGCTGTGTCAGCCAT GCAAGGCACCACG (SEQ ID NO: 785) |
| B_nm68 | 0.10 | 0.98 | 0.98 | 0.98 | 0.97 | 0.98 | 0.98 | 0.98 | CGCCTTCCGTATCAAAACC TAAATAGAAGTTGTTGTTA CCGTGTGCCAAT (SEQ ID NO: 786) |
| B_nm69 | 0.10 | 0.89 | 0.88 | 0.87 | 0.87 | 0.87 | 0.89 | 0.85 | CCCACTCTGTGACGCTCAG AAGATAGCATCCCCTCCTA AGGAACTTGCCG (SEQ ID NO: 787) |
| B_nm70 | 0.11 | 0.87 | 0.88 | 0.88 | 0.89 | 0.87 | 0.90 | 0.85 | CGTCATTGCCAACTCCAAT GCCTCAATGCACATGGCG GGGCCCAGCCACA (SEQ ID NO: 788) |
| B_nm71 | 0.11 | 0.89 | 0.87 | 0.86 | 0.88 | 0.86 | 0.90 | 0.90 | CTCCCTGAGGACCAGTTTT TTCCCCTGGGGAGTCATCA TGAATCACTTCG (SEQ ID NO: 789) |
| B_nm72 | 0.11 | 0.91 | 0.88 | 0.88 | 0.90 | 0.90 | 0.90 | 0.89 | CGGCTGCCCAACCCTGACT CCAGGCTGGACACTGGAG ATGATGCAGACCA (SEQ ID NO: 790) |
| B_nm73 | 0.12 | 0.97 | 0.96 | 0.96 | 0.96 | 0.97 | 0.96 | 0.96 | ACTCAGTGACTGACGTTTA CGGTCACACGAAGGAATC ACTACACCAAGCG (SEQ ID NO: 791) |
| B_nm74 | 0.13 | 0.92 | 0.91 | 0.91 | 0.92 | 0.92 | 0.92 | 0.91 | CGCACGGGCTCTGCCGTTC AGAACACAGCCACATCCC GTGATCTCATTTG (SEQ ID NO: 792) |
| B_nm75 | 0.13 | 0.88 | 0.85 | 0.86 | 0.89 | 0.88 | 0.89 | 0.88 | CTGAGTTTTCATCAAACAC CTGCTGAGCAGCTGGCAC GTGCCAGGACACG (SEQ ID NO: 793) |
| B_nm76 | 0.13 | 0.90 | 0.89 | 0.90 | 0.90 | 0.89 | 0.88 | 0.86 | CTAGAGACAAGCGATGAG CTGCACTGAGGATCAAGG ATCAGGCATTAGCG (SEQ ID NO: 794) |

TABLE 4B-continued

B-Cell Markers

| B_nm77 | 0.03 | 0.97 | 0.90 | 0.91 | 0.92 | 0.91 | 0.92 | 0.78 | CATCTGGGTGGCTGGAAA CCCAAGAACGGTGCCTAG CTCGGCTCTGTCCG (SEQ ID NO: 795) |
| --- | --- | --- | --- | --- | --- | --- | --- | --- | --- |
| B_nm78 | 0.04 | 0.90 | 0.96 | 0.94 | 0.97 | 0.96 | 0.97 | 0.95 | GGGCTCGTTCTGGCCTGCG CTGCGAGGGCTGTGGGCA CTGATGGGCAACG (SEQ ID NO: 796) |
| B_nm79 | 0.05 | 0.97 | 0.93 | 0.92 | 0.95 | 0.94 | 0.95 | 0.93 | CGAGGTCGGTCTCCCACG ACTGCCCACCATCTGGCCG GCCACCCTGAAAG (SEQ ID NO: 797) |
| B_nm80 | 0.10 | 0.97 | 0.96 | 0.97 | 0.97 | 0.97 | 0.97 | 0.96 | CGTGCCTGCCCCGCCGTGC ACACACCTCAGCCCCCGG GAGACGTGCCTGC (SEQ ID NO: 798) |
| B_nm81 | 0.05 | 0.96 | 0.92 | 0.95 | 0.95 | 0.93 | 0.93 | 0.83 | CGCCCCCACTCAGTCACAC GACACTGCTCTCCTGGCCC ACTGCGGCATCC (SEQ ID NO: 799) |
| B_nm82 | 0.03 | 0.92 | 0.76 | 0.80 | 0.82 | 0.82 | 0.91 | 0.87 | CGCTAACATTATGCTCTGT GGCAGGTTGCCCTGTCTGC TGTGCTCACCTT (SEQ ID NO: 800) |
| B_nm83 | 0.06 | 0.91 | 0.89 | 0.92 | 0.90 | 0.91 | 0.90 | 0.89 | CGCTGGTTGACTGGCAGA GCAACTTCTGGACCCAGC AGAGTTCAGCTTTG (SEQ ID NO: 801) |
| B_nm84 | 0.03 | 0.90 | 0.91 | 0.94 | 0.93 | 0.93 | 0.93 | 0.92 | CGTGCTCCAAGAAGTACA AAGAAAAAGTCAAAGCTA CAGCCGCTGACGGC (SEQ ID NO: 802) |
| B_nm85 | 0.03 | 0.82 | 0.86 | 0.83 | 0.85 | 0.79 | 0.96 | 0.94 | CGATATAAAATGAACGCG CGTTCAAGATTTCCTTCAA CTCATTGTTAGCG (SEQ ID NO: 803) |
| B_nm86 | 0.06 | 0.93 | 0.79 | 0.83 | 0.85 | 0.80 | 0.85 | 0.76 | CGGTTTACCACACCACCCT TGACTGGGAAATGGGGCT AAGATTTTAATAA (SEQ ID NO: 804) |
| B_nm87 | 0.05 | 0.92 | 0.87 | 0.89 | 0.89 | 0.88 | 0.93 | 0.86 | GGCCAGGGGAGCAGTGAG TCACTCAGGGCGGGATGG GTGAGGGGCGTCCG (SEQ ID NO: 805) |
| B_nm15 | 0.02 | 0.86 | 0.84 | 0.85 | 0.88 | 0.87 | 0.88 | 0.84 | CGGTCTCTACTCCAAGGG GCTCACATTCTTGTGCAGA AAACAGAAATGAA (SEQ ID NO: 806) |
| B_nm89 | 0.15 | 0.98 | 0.98 | 0.98 | 0.98 | 0.98 | 0.80 | 0.98 | CGGAGCAGCTGCCGCGCC TCGAAGTCACTGAAGCAG ACCACACACCTGTG (SEQ ID NO: 807) |
| B_nm90 | 0.06 | 0.90 | 0.84 | 0.81 | 0.84 | 0.84 | 0.90 | 0.81 | ACCCACAGAGAAGCTGCC ATCTAAATAGGGCTGATTT CGAGTTTTGGACG (SEQ ID NO: 808) |
| B_nm91 | 0.05 | 0.88 | 0.88 | 0.88 | 0.87 | 0.89 | 0.88 | 0.87 | AGCTCCTAGGTTTGAAAA GTTCTATGTGCGCTTGACC GGGGGGCCTTACG (SEQ ID NO: 809) |
| B_nm92 | 0.06 | 0.89 | 0.86 | 0.82 | 0.83 | 0.84 | 0.89 | 0.82 | CGTTAGCAAACACATAGT AGCAGAAACACCTGTCAG AGGACAGTGTCTCA (SEQ ID NO: 810) |
| B_nm93 | 0.04 | 0.89 | 0.86 | 0.88 | 0.87 | 0.89 | 0.90 | 0.86 | CGGGATGGAGTTCCCATA CCGTAGTTCAGAGGCATA GGGACTTCTGCATT (SEQ ID NO: 811) |
| B_nm94 | 0.06 | 0.89 | 0.85 | 0.86 | 0.88 | 0.88 | 0.84 | 0.79 | GACCCCAGGCTGCCATCTT GGCGCTAACTTCTTCCGAG GCAGAGCCAACG (SEQ ID NO: 812) |

TABLE 4C

CD8 positive T-Cell Markers

| Marker-ID | TargetID | SYMBOL | Accession | Basophil Granulocytes | Eosinophil Granulocytes | Neutrophil Granulocytes | Classical Monocytes | Non-Classical Monocytes | NK classical |
|---|---|---|---|---|---|---|---|---|---|
| CD8_nm12 | cg00219921 | CD8A | NM_001145873 | 0.91 | 0.90 | 0.92 | 0.90 | 0.89 | 0.90 |
| CD8_nm13 | cg25939861 | CD8A | NM_001145873 | 0.87 | 0.87 | 0.90 | 0.56 | 0.61 | 0.84 |
| CD8_nm14 | cg18857618 | CD8B | NM_172213 | 0.89 | 0.88 | 0.86 | 0.90 | 0.87 | 0.88 |
| CD8_nm15 | cg03318654 | CD8A | NM_001145873 | 0.71 | 0.73 | 0.72 | 0.73 | 0.71 | 0.74 |
| CD8_nm16 | cg25535316 | PHRF1 | NM_020901 | 0.86 | 0.84 | 0.84 | 0.83 | 0.82 | 0.86 |
| CD8_nm17 | cg07016730 | SBF1 | NM_002972 | 0.88 | 0.84 | 0.87 | 0.77 | 0.79 | 0.88 |
| CD8_nm18 | cg21648425 | CD8A | NM_001145873 | 0.74 | 0.74 | 0.75 | 0.55 | 0.51 | 0.67 |
| TEMRA_nm1 | cg04467549 | — | — | 0.92 | 0.94 | 0.94 | 0.65 | 0.67 | 0.84 |
| TEMRA_nm2 | cg20063728 | PDGFA | NM_002607 | 0.89 | 0.89 | 0.89 | 0.85 | 0.86 | 0.87 |
| TEMRA_nm3 | cg06567722 | PCID2 | NM_001127203 | 0.98 | 0.98 | 0.98 | 0.84 | 0.85 | 0.96 |
| TEMRA_nm4 | cg25002426 | KIF3C | NM_002254 | 0.92 | 0.92 | 0.89 | 0.87 | 0.87 | 0.91 |
| TEMRA_nm5 | cg21241195 | C6orf10 | NM_006781 | 0.92 | 0.90 | 0.91 | 0.88 | 0.86 | 0.90 |
| TEMRA_nm7 | cg02051545 | — | — | 0.90 | 0.91 | 0.92 | 0.86 | 0.85 | 0.89 |
| TEMRA_nm8 | cg20960322 | — | — | 0.74 | 0.86 | 0.84 | 0.61 | 0.74 | 0.78 |
| TEMRA_nm9 | cg06147361 | SOX5 | NM_152989 | 0.87 | 0.87 | 0.88 | 0.84 | 0.85 | 0.89 |
| TEMRA_nm10 | cg05173889 | TDRD9 | NM_153046 | 0.91 | 0.88 | 0.90 | 0.86 | 0.82 | 0.88 |
| TEMRA_nm11 | cg12080492 | MYBPH | NM_004997 | 0.91 | 0.90 | 0.94 | 0.87 | 0.88 | 0.93 |
| TEMRA_nm12 | cg00922200 | SEMA3A | NM_006080 | 0.84 | 0.84 | 0.88 | 0.87 | 0.87 | 0.83 |
| TEMRA_nm13 | cg19592003 | DEFB114 | NM_001037499 | 0.74 | 0.87 | 0.84 | 0.83 | 0.82 | 0.76 |
| TEMRA_nm14 | cg14317884 | EHD1 | NM_006795 | 0.92 | 0.82 | 0.85 | 0.82 | 0.79 | 0.91 |
| TEMRA_nm15 | cg00879541 | C14orf166 | NM_016039 | 0.89 | 0.90 | 0.89 | 0.87 | 0.86 | 0.88 |
| TEMRA_nm16 | cg24142603 | MSC | NM_005098 | 0.90 | 0.95 | 0.95 | 0.91 | 0.88 | 0.93 |
| TEMRA_nm17 | cg05585475 | — | — | 0.89 | 0.86 | 0.89 | 0.83 | 0.82 | 0.89 |
| TEMRA_nm18 | cg18080819 | SHANK2 | NM_012309 | 0.91 | 0.88 | 0.90 | 0.87 | 0.86 | 0.90 |
| TEMRA_nm19 | cg13486641 | NINL | NM_025176 | 0.92 | 0.93 | 0.96 | 0.94 | 0.94 | 0.93 |
| TEMRA_nm20 | cg13382516 | SGMS1 | NM_147156 | 0.87 | 0.86 | 0.89 | 0.79 | 0.78 | 0.86 |
| TEMRA_nm21 | cg26215982 | — | — | 0.87 | 0.91 | 0.90 | 0.83 | 0.82 | 0.90 |
| TEMRA_nm22 | cg03221073 | HMCN1 | NM_031935 | 0.90 | 0.88 | 0.89 | 0.87 | 0.85 | 0.88 |
| TEMRA_nm23 | cg02261543 | CTR9 | NM_014633 | 0.93 | 0.93 | 0.94 | 0.88 | 0.90 | 0.91 |
| TEMRA_nm24 | cg03938110 | NCRNA00110 | NR_027021 | 0.88 | 0.89 | 0.87 | 0.87 | 0.84 | 0.87 |
| TEMRA_nm25 | cg15449516 | — | — | 0.84 | 0.86 | 0.88 | 0.77 | 0.79 | 0.88 |
| TEMRA_nm26 | cg14365420 | — | — | 0.88 | 0.92 | 0.91 | 0.90 | 0.88 | 0.89 |
| TEMRA_nm27 | cg03668556 | — | — | 0.90 | 0.91 | 0.92 | 0.87 | 0.89 | 0.87 |
| TEMRA_nm28 | cg00472528 | — | — | 0.90 | 0.89 | 0.94 | 0.87 | 0.81 | 0.90 |
| TEMRA_nm29 | cg05633605 | ANKRD55 | NM_024669 | 0.82 | 0.79 | 0.81 | 0.81 | 0.79 | 0.80 |
| TEMRA_nm30 | cg27064867 | C6orf10 | NM_006781 | 0.90 | 0.91 | 0.91 | 0.89 | 0.86 | 0.90 |
| TEMRA_nm31 | cg18449136 | — | — | 0.88 | 0.89 | 0.89 | 0.84 | 0.83 | 0.87 |
| TEMRA_nm32 | cg13361307 | AFF3 | NM_001025108 | 0.81 | 0.80 | 0.79 | 0.78 | 0.78 | 0.81 |
| TEMRA_nm33 | cg25663823 | LRRK1 | NM_024652 | 0.95 | 0.95 | 0.95 | 0.90 | 0.90 | 0.94 |
| TEMRA_nm34 | cg24722886 | PLEKHA7 | NM_175058 | 0.81 | 0.81 | 0.84 | 0.75 | 0.72 | 0.84 |
| TEMRA_nm35 | cg01252713 | — | — | 0.88 | 0.90 | 0.87 | 0.87 | 0.87 | 0.88 |
| TEMRA_nm36 | cg09851620 | — | — | 0.90 | 0.91 | 0.92 | 0.88 | 0.87 | 0.89 |
| TEMRA_nm37 | cg26484813 | AHNAK | NM_024060 | 0.86 | 0.89 | 0.91 | 0.86 | 0.85 | 0.89 |
| TEMRA_nm38 | cg25370412 | — | — | 0.85 | 0.86 | 0.84 | 0.85 | 0.82 | 0.83 |
| TEMRA_nm39 | cg12522833 | GALR1 | NM_001480 | 0.87 | 0.92 | 0.92 | 0.92 | 0.88 | 0.87 |
| TEMRA_nm40 | cg26512948 | — | — | 0.89 | 0.91 | 0.92 | 0.89 | 0.83 | 0.87 |
| TEMRA_nm41 | cg06627009 | FSTL4 | NM_015082 | 0.85 | 0.89 | 0.92 | 0.89 | 0.86 | 0.91 |
| TEMRA_nm42 | cg01186212 | ANK3 | NM_020987 | 0.86 | 0.85 | 0.82 | 0.81 | 0.83 | 0.82 |
| TEMRA_nm43 | cg20940398 | SYNPO | NM_001166208 | 0.89 | 0.87 | 0.88 | 0.80 | 0.78 | 0.83 |
| TEMRA_nm44 | cg04230397 | MUC21 | NM_001010909 | 0.85 | 0.84 | 0.86 | 0.82 | 0.81 | 0.84 |
| TEMRA_nm45 | cg15617591 | — | — | 0.84 | 0.91 | 0.89 | 0.86 | 0.84 | 0.83 |
| TEMRA_nm46 | cg22112587 | — | — | 0.85 | 0.87 | 0.90 | 0.83 | 0.82 | 0.90 |
| TEMRA_nm47 | cg15302350 | LRP5 | NM_002335 | 0.88 | 0.88 | 0.89 | 0.85 | 0.86 | 0.89 |
| TEMRA_nm48 | cg19675599 | — | — | 0.89 | 0.90 | 0.86 | 0.86 | 0.88 | 0.90 |
| TEMRA_nm49 | cg25314245 | APP | NM_201413 | 0.88 | 0.88 | 0.93 | 0.88 | 0.86 | 0.90 |
| TEMRA_nm50 | cg17037931 | — | — | 0.83 | 0.84 | 0.84 | 0.85 | 0.83 | 0.85 |
| TEMRA_nm51 | cg11375831 | SERPINI2 | NM_006217 | 0.90 | 0.88 | 0.88 | 0.87 | 0.86 | 0.88 |
| TEMRA_nm52 | cg18766691 | LPCAT1 | NM_024830 | 0.90 | 0.91 | 0.92 | 0.85 | 0.86 | 0.89 |
| TEMRA_nm53 | cg10104542 | — | — | 0.84 | 0.82 | 0.90 | 0.83 | 0.80 | 0.84 |
| TEMRA_nm54 | cg01071903 | — | — | 0.88 | 0.89 | 0.90 | 0.85 | 0.85 | 0.84 |
| TEMRA_nm55 | cg12695059 | — | — | 0.93 | 0.91 | 0.91 | 0.85 | 0.86 | 0.91 |
| TEMRA_nm56 | cg11268546 | — | — | 0.89 | 0.88 | 0.88 | 0.86 | 0.85 | 0.88 |
| TEMRA_nm57 | cg19277516 | — | — | 0.90 | 0.89 | 0.87 | 0.89 | 0.89 | 0.88 |
| TEMRA_nm58 | cg25180759 | MED13L | NM_015335 | 0.83 | 0.91 | 0.92 | 0.83 | 0.83 | 0.89 |
| TEMRA_nm59 | cg16966340 | — | — | 0.88 | 0.85 | 0.89 | 0.86 | 0.87 | 0.87 |
| TEMRA_nm60 | cg23645373 | — | — | 0.83 | 0.89 | 0.89 | 0.73 | 0.74 | 0.84 |
| TEMRA_nm61 | cg23642827 | — | — | 0.91 | 0.92 | 0.90 | 0.82 | 0.83 | 0.86 |
| TEMRA_nm62 | cg27398140 | PPAP2B | NM_003713.4 | 0.88 | 0.90 | 0.90 | 0.86 | 0.84 | 0.90 |
| TEMRA_nm63 | cg26372842 | OR8S1 | NM_001005203 | 0.88 | 0.88 | 0.90 | 0.86 | 0.87 | 0.85 |
| TEMRA_nm64 | cg02936931 | — | — | 0.85 | 0.84 | 0.80 | 0.78 | 0.80 | 0.87 |

TABLE 4C-continued

CD8 positive T-Cell Markers

| | | | | | | | | | |
|---|---|---|---|---|---|---|---|---|---|
| TEMRA_nm65 | cg10381153 | CACHD1 | NM_020925 | 0.90 | 0.90 | 0.92 | 0.88 | 0.91 | 0.89 |
| TEMRA_nm66 | cg06951647 | COL4A2 | NM_001846 | 0.88 | 0.87 | 0.86 | 0.89 | 0.85 | 0.88 |
| TEMRA_nm67 | cg13177421 | EPS8 | NM_004447 | 0.85 | 0.80 | 0.84 | 0.87 | 0.79 | 0.81 |

| Marker-ID | NK bright | B-Cells | MDSC | CD4+ Th naive | CD4+ act. | CD4+ Th1 | CD4+ Th2 | CD4+ Th Central Mem. | CD4+ Th Effect. Mem. | CD4+ NK T cells |
|---|---|---|---|---|---|---|---|---|---|---|
| CD8_nm12 | 0.90 | 0.92 | 0.85 | 0.84 | 0.80 | 0.80 | 0.80 | 0.85 | 0.85 | 0.76 |
| CD8_nm13 | 0.86 | 0.84 | 0.81 | 0.80 | 0.79 | 0.79 | 0.79 | 0.84 | 0.82 | 0.69 |
| CD8_nm14 | 0.89 | 0.84 | 0.85 | 0.86 | 0.76 | 0.78 | 0.77 | 0.82 | 0.79 | 0.74 |
| CD8_nm15 | 0.74 | 0.72 | 0.70 | 0.72 | 0.69 | 0.70 | 0.69 | 0.71 | 0.72 | 0.75 |
| CD8_nm16 | 0.88 | 0.76 | 0.83 | 0.73 | 0.59 | 0.67 | 0.65 | 0.64 | 0.68 | 0.59 |
| CD8_nm17 | 0.87 | 0.70 | 0.82 | 0.75 | 0.56 | 0.58 | 0.53 | 0.61 | 0.59 | 0.58 |
| CD8_nm18 | 0.72 | 0.71 | 0.58 | 0.69 | 0.57 | 0.70 | 0.71 | 0.70 | 0.75 | 0.56 |
| TEMRA_nm1 | 0.93 | 0.93 | 0.89 | 0.93 | 0.90 | 0.83 | 0.87 | 0.90 | 0.89 | 0.79 |
| TEMRA_nm2 | 0.90 | 0.89 | 0.86 | 0.92 | 0.80 | 0.69 | 0.85 | 0.82 | 0.79 | 0.65 |
| TEMRA_nm3 | 0.98 | 0.98 | 0.97 | 0.96 | 0.95 | 0.95 | 0.97 | 0.97 | 0.97 | 0.77 |
| TEMRA_nm4 | 0.90 | 0.83 | 0.87 | 0.93 | 0.86 | 0.59 | 0.75 | 0.78 | 0.76 | 0.53 |
| TEMRA_nm5 | 0.92 | 0.73 | 0.86 | 0.80 | 0.92 | 0.92 | 0.92 | 0.74 | 0.55 | 0.79 |
| TEMRA_nm7 | 0.92 | 0.90 | 0.89 | 0.91 | 0.81 | 0.72 | 0.75 | 0.76 | 0.73 | 0.65 |
| TEMRA_nm8 | 0.80 | 0.89 | 0.82 | 0.70 | 0.87 | 0.85 | 0.89 | 0.88 | 0.87 | 0.67 |
| TEMRA_nm9 | 0.92 | 0.63 | 0.87 | 0.92 | 0.75 | 0.72 | 0.76 | 0.75 | 0.74 | 0.66 |
| TEMRA_nm10 | 0.93 | 0.81 | 0.88 | 0.88 | 0.70 | 0.58 | 0.62 | 0.71 | 0.65 | 0.68 |
| TEMRA_nm11 | 0.95 | 0.91 | 0.91 | 0.94 | 0.79 | 0.64 | 0.71 | 0.79 | 0.74 | 0.62 |
| TEMRA_nm12 | 0.84 | 0.74 | 0.86 | 0.90 | 0.74 | 0.65 | 0.67 | 0.76 | 0.68 | 0.61 |
| TEMRA_nm13 | 0.79 | 0.90 | 0.87 | 0.71 | 0.73 | 0.86 | 0.83 | 0.73 | 0.57 | 0.66 |
| TEMRA_nm14 | 0.91 | 0.89 | 0.84 | 0.93 | 0.64 | 0.63 | 0.64 | 0.73 | 0.72 | 0.60 |
| TEMRA_nm15 | 0.84 | 0.84 | 0.87 | 0.90 | 0.79 | 0.72 | 0.80 | 0.81 | 0.77 | 0.58 |
| TEMRA_nm16 | 0.95 | 0.93 | 0.90 | 0.95 | 0.83 | 0.87 | 0.83 | 0.86 | 0.78 | 0.59 |
| TEMRA_nm17 | 0.90 | 0.81 | 0.88 | 0.90 | 0.86 | 0.81 | 0.83 | 0.86 | 0.86 | 0.70 |
| TEMRA_nm18 | 0.89 | 0.82 | 0.87 | 0.89 | 0.68 | 0.60 | 0.64 | 0.70 | 0.66 | 0.64 |
| TEMRA_nm19 | 0.95 | 0.87 | 0.93 | 0.96 | 0.88 | 0.78 | 0.79 | 0.85 | 0.84 | 0.74 |
| TEMRA_nm20 | 0.89 | 0.75 | 0.84 | 0.89 | 0.68 | 0.67 | 0.74 | 0.72 | 0.69 | 0.58 |
| TEMRA_nm21 | 0.91 | 0.81 | 0.87 | 0.94 | 0.77 | 0.59 | 0.70 | 0.74 | 0.67 | 0.57 |
| TEMRA_nm22 | 0.90 | 0.71 | 0.83 | 0.92 | 0.74 | 0.66 | 0.76 | 0.73 | 0.71 | 0.63 |
| TEMRA_nm23 | 0.91 | 0.87 | 0.91 | 0.93 | 0.89 | 0.89 | 0.82 | 0.87 | 0.89 | 0.81 |
| TEMRA_nm24 | 0.86 | 0.75 | 0.85 | 0.90 | 0.69 | 0.58 | 0.62 | 0.69 | 0.65 | 0.64 |
| TEMRA_nm25 | 0.85 | 0.64 | 0.86 | 0.91 | 0.81 | 0.67 | 0.71 | 0.72 | 0.68 | 0.58 |
| TEMRA_nm26 | 0.90 | 0.80 | 0.88 | 0.90 | 0.70 | 0.61 | 0.64 | 0.71 | 0.68 | 0.66 |
| TEMRA_nm27 | 0.88 | 0.85 | 0.89 | 0.90 | 0.89 | 0.84 | 0.88 | 0.89 | 0.83 | 0.78 |
| TEMRA_nm28 | 0.93 | 0.81 | 0.86 | 0.94 | 0.68 | 0.64 | 0.69 | 0.76 | 0.70 | 0.61 |
| TEMRA_nm29 | 0.82 | 0.67 | 0.79 | 0.89 | 0.70 | 0.60 | 0.70 | 0.74 | 0.71 | 0.59 |
| TEMRA_nm30 | 0.89 | 0.82 | 0.88 | 0.92 | 0.68 | 0.82 | 0.82 | 0.76 | 0.73 | 0.67 |
| TEMRA_nm31 | 0.86 | 0.83 | 0.86 | 0.89 | 0.73 | 0.59 | 0.70 | 0.72 | 0.67 | 0.71 |
| TEMRA_nm32 | 0.82 | 0.82 | 0.80 | 0.86 | 0.78 | 0.59 | 0.68 | 0.72 | 0.66 | 0.61 |
| TEMRA_nm33 | 0.96 | 0.95 | 0.93 | 0.94 | 0.66 | 0.57 | 0.62 | 0.70 | 0.63 | 0.55 |
| TEMRA_nm34 | 0.85 | 0.81 | 0.81 | 0.86 | 0.65 | 0.55 | 0.57 | 0.66 | 0.61 | 0.65 |
| TEMRA_nm35 | 0.88 | 0.77 | 0.85 | 0.90 | 0.65 | 0.53 | 0.59 | 0.66 | 0.61 | 0.57 |
| TEMRA_nm36 | 0.91 | 0.84 | 0.89 | 0.92 | 0.68 | 0.62 | 0.67 | 0.72 | 0.66 | 0.67 |
| TEMRA_nm37 | 0.86 | 0.88 | 0.84 | 0.92 | 0.86 | 0.70 | 0.75 | 0.79 | 0.71 | 0.67 |
| TEMRA_nm38 | 0.84 | 0.78 | 0.85 | 0.87 | 0.59 | 0.64 | 0.71 | 0.69 | 0.67 | 0.67 |
| TEMRA_nm39 | 0.90 | 0.89 | 0.89 | 0.90 | 0.85 | 0.80 | 0.85 | 0.87 | 0.84 | 0.78 |
| TEMRA_nm40 | 0.89 | 0.75 | 0.86 | 0.90 | 0.78 | 0.63 | 0.67 | 0.67 | 0.69 | 0.60 |
| TEMRA_nm41 | 0.93 | 0.77 | 0.87 | 0.92 | 0.76 | 0.69 | 0.79 | 0.81 | 0.77 | 0.76 |
| TEMRA_nm42 | 0.83 | 0.91 | 0.82 | 0.89 | 0.85 | 0.71 | 0.71 | 0.75 | 0.62 | 0.77 |
| TEMRA_nm43 | 0.88 | 0.81 | 0.81 | 0.89 | 0.74 | 0.65 | 0.72 | 0.73 | 0.71 | 0.55 |
| TEMRA_nm44 | 0.85 | 0.72 | 0.83 | 0.87 | 0.70 | 0.57 | 0.61 | 0.67 | 0.65 | 0.60 |
| TEMRA_nm45 | 0.83 | 0.79 | 0.86 | 0.91 | 0.64 | 0.56 | 0.60 | 0.69 | 0.62 | 0.60 |
| TEMRA_nm46 | 0.89 | 0.80 | 0.86 | 0.90 | 0.75 | 0.65 | 0.73 | 0.79 | 0.72 | 0.67 |
| TEMRA_nm47 | 0.89 | 0.68 | 0.84 | 0.90 | 0.72 | 0.62 | 0.66 | 0.67 | 0.64 | 0.56 |
| TEMRA_nm48 | 0.90 | 0.79 | 0.89 | 0.90 | 0.63 | 0.52 | 0.59 | 0.65 | 0.63 | 0.67 |
| TEMRA_nm49 | 0.91 | 0.88 | 0.90 | 0.92 | 0.87 | 0.80 | 0.87 | 0.88 | 0.83 | 0.75 |
| TEMRA_nm50 | 0.83 | 0.71 | 0.81 | 0.86 | 0.62 | 0.54 | 0.57 | 0.66 | 0.62 | 0.67 |
| TEMRA_nm51 | 0.88 | 0.77 | 0.87 | 0.88 | 0.68 | 0.60 | 0.64 | 0.70 | 0.65 | 0.65 |
| TEMRA_nm52 | 0.90 | 0.64 | 0.87 | 0.92 | 0.77 | 0.67 | 0.84 | 0.70 | 0.67 | 0.67 |
| TEMRA_nm53 | 0.84 | 0.68 | 0.81 | 0.90 | 0.67 | 0.60 | 0.73 | 0.75 | 0.73 | 0.70 |
| TEMRA_nm54 | 0.88 | 0.79 | 0.87 | 0.87 | 0.73 | 0.64 | 0.70 | 0.73 | 0.69 | 0.67 |
| TEMRA_nm55 | 0.92 | 0.92 | 0.89 | 0.86 | 0.78 | 0.79 | 0.83 | 0.85 | 0.84 | 0.72 |
| TEMRA_nm56 | 0.87 | 0.75 | 0.85 | 0.88 | 0.64 | 0.57 | 0.63 | 0.67 | 0.63 | 0.59 |
| TEMRA_nm57 | 0.85 | 0.82 | 0.85 | 0.90 | 0.71 | 0.55 | 0.66 | 0.76 | 0.66 | 0.66 |
| TEMRA_nm58 | 0.90 | 0.84 | 0.89 | 0.93 | 0.84 | 0.79 | 0.82 | 0.84 | 0.79 | 0.63 |
| TEMRA_nm59 | 0.81 | 0.79 | 0.83 | 0.91 | 0.71 | 0.63 | 0.69 | 0.74 | 0.71 | 0.64 |
| TEMRA_nm60 | 0.85 | 0.83 | 0.83 | 0.86 | 0.72 | 0.63 | 0.63 | 0.72 | 0.65 | 0.67 |
| TEMRA_nm61 | 0.90 | 0.80 | 0.88 | 0.89 | 0.78 | 0.60 | 0.79 | 0.77 | 0.74 | 0.61 |
| TEMRA_nm62 | 0.90 | 0.89 | 0.88 | 0.90 | 0.67 | 0.57 | 0.59 | 0.67 | 0.64 | 0.62 |
| TEMRA_nm63 | 0.89 | 0.79 | 0.86 | 0.86 | 0.78 | 0.58 | 0.66 | 0.71 | 0.71 | 0.64 |
| TEMRA_nm64 | 0.87 | 0.69 | 0.84 | 0.92 | 0.65 | 0.54 | 0.62 | 0.69 | 0.61 | 0.54 |

TABLE 4C-continued

| | CD8 positive T-Cell Markers | | | | | | | | | |
|---|---|---|---|---|---|---|---|---|---|---|
| TEMRA_nm65 | 0.92 | 0.79 | 0.90 | 0.92 | 0.77 | 0.63 | 0.71 | 0.74 | 0.69 | 0.67 |
| TEMRA_nm66 | 0.87 | 0.82 | 0.86 | 0.90 | 0.66 | 0.57 | 0.66 | 0.72 | 0.66 | 0.63 |
| TEMRA_nm67 | 0.87 | 0.79 | 0.83 | 0.87 | 0.65 | 0.57 | 0.60 | 0.71 | 0.60 | 0.56 |

| Marker-ID | CD4+ TFH | CD8+ Cyto-toxic T-Cells | CD8+ naive T8n_1 | CD8+ act. | CD8+ Th Central Mem. | CD8+ Th Effect. Mem. | TEMRA | CD8+ NK cells | NK T-Cells | Discovery Fragment |
|---|---|---|---|---|---|---|---|---|---|---|
| CD8_nm12 | 0.81 | 0.08 | 0.10 | 0.18 | 0.29 | 0.13 | 0.07 | 0.23 | 0.18 | TAAAATCTACAGTACACCACAAGGGTCACAATACTGTTGTGCGCACATCG (SEQ ID NO: 813) |
| CD8_nm13 | 0.82 | 0.07 | 0.07 | 0.15 | 0.11 | 0.07 | 0.05 | 0.10 | 0.12 | CGGAAATCAGCTTGGGGGCCTTCTAGCCCTGCAGCTCAGAAAAGTGTCAG (SEQ ID NO: 814) |
| CD8_nm14 | 0.77 | 0.20 | 0.22 | 0.30 | 0.47 | 0.39 | 0.14 | 0.35 | 0.39 | CGAGGTGGATATTAGCAACTCCTTTAGCAGGGCTCAATGGCGTCTTAGAA (SEQ ID NO: 815) |
| CD8_nm15 | 0.71 | 0.15 | 0.17 | 0.22 | 0.20 | 0.21 | 0.17 | 0.25 | 0.24 | TCCAACCAATTGTGCTCTCCCAATTCCAACAACCAAATGAAGCTTCAACG (SEQ ID NO: 816) |
| CD8_nm16 | 0.61 | 0.21 | 0.13 | 0.45 | 0.45 | 0.44 | 0.29 | 0.47 | 0.50 | ATTTTTTACTTTCTATGTGAAATTCATCATCAAATGAGGATTTGCACTCG (SEQ ID NO: 817) |
| CD8_nm17 | 0.53 | 0.19 | 0.21 | 0.26 | 0.39 | 0.26 | 0.24 | 0.29 | 0.30 | GCCCACCGGGGTTGCCCTGGTGTTGCCCCCATCTGTAGAGAAGTTAGGCG (SEQ ID NO: 818) |
| CD8_nm18 | 0.60 | 0.22 | 0.25 | 0.31 | 0.27 | 0.28 | 0.24 | 0.27 | 0.27 | CGCTGTTTTGCTCAGGCTGGCCTTGGGACTCCTGAGCTCCAGTGATCCTC (SEQ ID NO: 819) |
| TEMRA_nm1 | 0.91 | 0.58 | 0.86 | 0.29 | 0.28 | 0.19 | 0.12 | 0.19 | 0.33 | TCTGTCAGAGGGCTGTTGTGGGATTATAAGAGCCCACTTGTGAAATTGCG (SEQ ID NO: 820) |
| TEMRA_nm2 | 0.83 | 0.63 | 0.85 | 0.38 | 0.35 | 0.28 | 0.11 | 0.15 | 0.13 | GTCTTTGCCTGACACCTTCTGTGAGGTTTGCGGGCTTCATTTTAAATCCG (SEQ ID NO: 821) |
| TEMRA_nm3 | 0.94 | 0.89 | 0.97 | 0.93 | 0.76 | 0.59 | 0.22 | 0.42 | 0.60 | CGAGGCGCTGGCGAAGCACGAGGCCTTCTTCATTCGCTGCGGAATCTTCC (SEQ ID NO: 822) |
| TEMRA_nm4 | 0.87 | 0.65 | 0.92 | 0.56 | 0.46 | 0.40 | 0.12 | 0.27 | 0.36 | CGAAAGCAAGCGAGTGAATTAGGATTTCAAAGTGCCCTAATAGTGTGAGT (SEQ ID NO: 823) |
| TEMRA_nm5 | 0.85 | 0.92 | 0.92 | 0.91 | 0.87 | 0.89 | 0.14 | 0.87 | 0.85 | CGGCACAGATAAAAATACAGAGACAATGGTTCCGACCCAGAGATGAGGCT (SEQ ID NO: 824) |
| TEMRA_nm7 | 0.83 | 0.71 | 0.91 | 0.46 | 0.55 | 0.38 | 0.14 | 0.27 | 0.27 | GTCCGCAGTAATAACAACCAAAGACACATATTCTCAGGCAATGATAACCG (SEQ ID NO: 825) |

TABLE 4C-continued

CD8 positive T-Cell Markers

| | | | | | | | | | | |
|---|---|---|---|---|---|---|---|---|---|---|
| TEMRA_nm8 | 0.88 | 0.72 | 0.89 | 0.86 | 0.83 | 0.66 | 0.11 | 0.74 | 0.57 | CATGAGAAAACTTCT TTAAGACCACCTGTA GAATTCTGCAATCAC ATACG (SEQ ID NO: 826) |
| TEMRA_nm9 | 0.78 | 0.65 | 0.89 | 0.44 | 0.40 | 0.40 | 0.12 | 0.25 | 0.23 | CGGAAGAATGAAAA GCTAATATTATTGTG TGGCATGATGACTGT CTCTTC (SEQ ID NO: 827) |
| TEMRA_nm10 | 0.72 | 0.72 | 0.89 | 0.49 | 0.59 | 0.50 | 0.11 | 0.47 | 0.38 | CGCCCCACCCCAGAA CCAGCTAGCACCCAA GGGCTAGGCAGCCTG CTACT (SEQ ID NO: 828) |
| TEMRA_nm11 | 0.78 | 0.76 | 0.92 | 0.60 | 0.69 | 0.55 | 0.16 | 0.45 | 0.42 | TGCTGTGGGCCTCAG TTTTCCACCTGTTAC AGAGAACCCCTCGCC CTTCG (SEQ ID NO: 829) |
| TEMRA_nm12 | 0.72 | 0.72 | 0.86 | 0.50 | 0.47 | 0.51 | 0.11 | 0.41 | 0.35 | CGGGAATCTGTCTGT GTTACAAAGCAACTA GACTCACCCTATTGG CCTAA (SEQ ID NO: 830) |
| TEMRA_nm13 | 0.80 | 0.82 | 0.86 | 0.73 | 0.72 | 0.61 | 0.12 | 0.79 | 0.76 | CGGTCGTTGTAAAAG AGACTGTCTTGAGAG TGAAAAGCAAATAG ACATAT (SEQ ID NO: 831) |
| TEMRA_nm14 | 0.64 | 0.68 | 0.89 | 0.49 | 0.49 | 0.38 | 0.11 | 0.25 | 0.27 | CCTTCTCTTCCCCCC AGGCTATGACTTTGC AGCCGTCCTGGAGTG GTTCG (SEQ ID NO: 832) |
| TEMRA_nm15 | 0.82 | 0.70 | 0.89 | 0.49 | 0.42 | 0.36 | 0.16 | 0.34 | 0.17 | GGGGTTATATATTTT TGACCAAATTCACCA TTACTCATTTGGCAT TTTCG (SEQ ID NO: 833) |
| TEMRA_nm16 | 0.86 | 0.69 | 0.91 | 0.36 | 0.41 | 0.43 | 0.20 | 0.30 | 0.40 | CGCGCAGGGTGGGC GGCTTACCATAGCAA GTGATCCTGCGATAG GGAACG (SEQ ID NO: 834) |
| TEMRA_nm17 | 0.87 | 0.67 | 0.85 | 0.39 | 0.41 | 0.35 | 0.19 | 0.27 | 0.27 | CGGTAGACAAATGAT AGACATTTGTTGAAT CAAGCTGTGAGTTGG AGATC (SEQ ID NO: 835) |
| TEMRA_nm18 | 0.64 | 0.74 | 0.88 | 0.47 | 0.66 | 0.56 | 0.13 | 0.51 | 0.52 | CGCCACCCCACCTTC ATCCACGGACTCCAG GTACTGTAGGGCTGG GAAAG (SEQ ID NO: 836) |
| TEMRA_nm19 | 0.87 | 0.84 | 0.95 | 0.56 | 0.75 | 0.58 | 0.23 | 0.56 | 0.49 | CAGTGACGTGGTGGG GAGCGTGTGCTTGTG TAGGGACAGCTTTCC AGGCG (SEQ ID NO: 837) |
| TEMRA_nm20 | 0.71 | 0.61 | 0.86 | 0.39 | 0.34 | 0.29 | 0.13 | 0.22 | 0.20 | CGTGCCCAGCTTTTC TATGGGAAAAATTGT TCTTCAGACAGAGCA TGAAT (SEQ ID NO: 838) |
| TEMRA_nm21 | 0.82 | 0.59 | 0.93 | 0.32 | 0.36 | 0.19 | 0.16 | 0.19 | 0.15 | GCGTACACACCCTGA TAAGGTGTCAAGAAC CTCCGTTTGAGTACC CCTCG (SEQ ID NO: 839) |
| TEMRA_nm22 | 0.79 | 0.66 | 0.89 | 0.58 | 0.59 | 0.45 | 0.15 | 0.34 | 0.30 | ACTTAGAGCCCACCA TGAAGCATCTTTTCT GTTGCTTCACTGACT CACCG (SEQ ID NO: 840) |

TABLE 4C-continued

CD8 positive T-Cell Markers

| | | | | | | | | | |
|---|---|---|---|---|---|---|---|---|---|
| TEMRA_nm23 | 0.89 | 0.82 | 0.92 | 0.71 | 0.73 | 0.80 | 0.24 | 0.63 | 0.60 | GGCCTTCTCTTTCTG GATGGCTGGTCACTG TCTGAGTCCTGATCT GACCG (SEQ ID NO: 841) |
| TEMRA_nm24 | 0.67 | 0.69 | 0.86 | 0.39 | 0.47 | 0.40 | 0.13 | 0.38 | 0.34 | CGGTATTTCAGTTAC ACTCTGTTGATTCAA AAGAAGGTTGTTTGT CCAAG (SEQ ID NO: 842) |
| TEMRA_nm25 | 0.85 | 0.67 | 0.89 | 0.62 | 0.50 | 0.35 | 0.15 | 0.18 | 0.22 | TTGCTCCAGCACTAC AGAGCAGATTTGGA GCAGTCAGGTGGGG AAGCTCG (SEQ ID NO: 843) |
| TEMRA_nm26 | 0.75 | 0.73 | 0.89 | 0.51 | 0.63 | 0.52 | 0.16 | 0.48 | 0.44 | CGGTCCTCACCTCAC TAGATCACCATGACT CACTGGGTAGATGGG CTATT (SEQ ID NO: 844) |
| TEMRA_nm27 | 0.88 | 0.81 | 0.88 | 0.80 | 0.81 | 0.74 | 0.22 | 0.54 | 0.60 | CGCTATTGCTAAGTA AAACCCATGTGTTTT CAGTCATGGTTAGCA GCAGG (SEQ ID NO: 845) |
| TEMRA_nm28 | 0.68 | 0.73 | 0.89 | 0.42 | 0.55 | 0.38 | 0.16 | 0.32 | 0.32 | CGAGGACGAATCTTG AGGCCTCCACTGGIC TACACGGACAGAAG CACGCC (SEQ ID NO: 346) |
| TEMRA_nm29 | 0.72 | 0.71 | 0.85 | 0.39 | 0.57 | 0.47 | 0.11 | 0.29 | 0.32 | CGTGGGAAAGTAAT ACAGGGAGGGAACA GCAGCCCATAAAAA GAACGTTA (SEQ ID NO: 847) |
| TEMRA_nm30 | 0.72 | 0.80 | 0.92 | 0.57 | 0.57 | 0.48 | 0.18 | 0.56 | 0.49 | CTCATCTTAAGGATG CTTATTATCATAATG CTTTTTATAATTCCTA ATCG (SEQ ID NO: 848) |
| TEMRA_nm31 | 0.74 | 0.74 | 0.88 | 0.45 | 0.55 | 0.48 | 0.15 | 0.35 | 0.38 | CTCTTAACCTGGTGG TCTTTCACTAGCTTT ACAAAGGTGATACA GTTTCG (SEQ ID NO: 849) |
| TEMRA_nm32 | 0.79 | 0.65 | 0.84 | 0.58 | 0.53 | 0.51 | 0.12 | 0.39 | 0.33 | CGAGGCTCTGCACAG GTAAACTCAAGGGTT ACCCTGTGCTTTGAA ACCTT (SEQ ID NO: 850) |
| TEMRA_nm33 | 0.65 | 0.76 | 0.93 | 0.49 | 0.49 | 0.40 | 0.18 | 0.35 | 0.35 | TCAGCCCCGGAGGGC AGGCGCCAGTCCATC AGCTTGTATGTCTGT CCTCG (SEQ ID NO: 851) |
| TEMRA_nm34 | 0.71 | 0.59 | 0.82 | 0.34 | 0.35 | 0.40 | 0.10 | 0.25 | 0.26 | CGAGTGTGGAGCTAT GATTGGAACCTAGTT CAGGCTCCAAAGCCA CACTC (SEQ ID NO: 852) |
| TEMRA_nm35 | 0.61 | 0.69 | 0.89 | 0.43 | 0.58 | 0.49 | 0.12 | 0.44 | 0.39 | CGACCATTCTCACAA GACATTGAACAGAG AATAAGAGGAGAGA AAAAGGC (SEQ ID NO: 853) |
| TEMRA_nm36 | 0.74 | 0.74 | 0.92 | 0.50 | 0.66 | 0.57 | 0.17 | 0.54 | 0.46 | AAGTTCCCATTAGAT GACTCACTTCAGGAG GGCAGGAACCATTCT GTTCG (SEQ ID NO: 854) |
| TEMRA_nm37 | 0.87 | 0.75 | 0.90 | 0.63 | 0.73 | 0.53 | 0.19 | 0.40 | 0.28 | CGGCTCTGCCAGGAC CCACCAGCCAATTCC AAGTCGAGCAAAAG AATCCA (SEQ ID NO: 855) |

TABLE 4C-continued

CD8 positive T-Cell Markers

| | | | | | | | | | | |
|---|---|---|---|---|---|---|---|---|---|---|
| TEMRA_nm38 | 0.68 | 0.74 | 0.83 | 0.54 | 0.55 | 0.56 | 0.13 | 0.58 | 0.49 | ACTGTTGATCCTGGG AGTCTCTGGCCTTGT ATTTATGACTTATCA ATTCG (SEQ ID NO: 856) |
| TEMRA_nm39 | 0.85 | 0.87 | 0.86 | 0.80 | 0.83 | 0.81 | 0.23 | 0.79 | 0.75 | ATTCTGTCTAGTCTTT GGTCCCATAGAAATT ATTATCTACATCAAC CTCG (SEQ ID NO: 857) |
| TEMRA_nm40 | 0.81 | 0.69 | 0.91 | 0.50 | 0.41 | 0.46 | 0.16 | 0.30 | 0.33 | ACACTTCTGGCAAAT AGTTCATCTAATTAG AACCATGGGAAACC CCTCCG (SEQ ID NO: 858) |
| TEMRA_nm41 | 0.76 | 0.77 | 0.89 | 0.50 | 0.64 | 0.64 | 0.19 | 0.57 | 0.56 | CGGGGATTCCAACCC CAGGGCACCTCTCTG GCATTCCCATTAAGG AAGCC (SEQ ID NO: 859) |
| TEMRA_nm42 | 0.81 | 0.79 | 0.86 | 0.67 | 0.44 | 0.57 | 0.16 | 0.49 | 0.51 | ATTTGTAACATCACA AGAGTTAGAAGACC CCATATTGCTTGAGC TTTTCG (SEQ ID NO: 860) |
| TEMRA_nm43 | 0.76 | 0.70 | 0.83 | 0.46 | 0.52 | 0.43 | 0.14 | 0.33 | 0.35 | CGAGGCTTGTGCTCT TGGCCACCACTGTCT TCTGGAATTATAGGA GTAAA (SEQ ID NO: 861) |
| TEMRA_nm44 | 0.73 | 0.66 | 0.86 | 0.42 | 0.52 | 0.43 | 0.13 | 0.26 | 0.33 | CGAGTAAAATGATG ATCCTCACTCTATGG AAGAGAAGCAGAGC TGGCCCC (SEQ ID NO: 862) |
| TEMRA_nm45 | 0.64 | 0.72 | 0.87 | 0.48 | 0.50 | 0.41 | 0.13 | 0.40 | 0.35 | CGCCTGGAATTTCTT GAAACACCCTTATAC ATGCATAAAACTGTA GGTGG (SEQ ID NO: 863) |
| TEMRA_nm46 | 0.77 | 0.64 | 0.89 | 0.39 | 0.46 | 0.42 | 0.17 | 0.31 | 0.31 | CGGTCTTGGGTGGCC CATAGGAGATTAAG AATTTCCTATTATCC AAGCTG (SEQ ID NO: 864) |
| TEMRA_nm47 | 0.75 | 0.65 | 0.90 | 0.51 | 0.52 | 0.45 | 0.15 | 0.46 | 0.38 | CGGCCAGGCTGCAAT GCACATGGCCGCCCT CATTGGCAGGGTCAC ATGAG (SEQ ID NO: 865) |
| TEMRA_nm48 | 0.65 | 0.71 | 0.92 | 0.41 | 0.56 | 0.49 | 0.15 | 0.45 | 0.40 | CGCCACAAATGAGTA AAGCAGGTCTAGCA GGCTTGTCTGTTGAG TTACTG (SEQ ID NO: 866) |
| TEMRA_nm49 | 0.89 | 0.80 | 0.90 | 0.59 | 0.72 | 0.61 | 0.24 | 0.51 | 0.55 | CGAGACACCTGGGG ATGAGAATGAACAT GCCCATTTCCAGAAA GCCAAAG (SEQ ID NO: 867) |
| TEMRA_nm50 | 0.64 | 0.71 | 0.83 | 0.43 | 0.55 | 0.45 | 0.11 | 0.47 | 0.42 | CCCCTTTTTCCCAGG GACCCACAGAACTGT GAGCAAGAAATAAA TGTTCG (SEQ ID NO: 868) |
| TEMRA_nm51 | 0.69 | 0.74 | 0.89 | 0.53 | 0.68 | 0.49 | 0.16 | 0.50 | 0.48 | CGGTCTCTGCCATTG GTAGGAAAAGTAAT GGACTATTTCTGGAT AAATCA (SEQ ID NO: 869) |
| TEMRA_nm52 | 0.83 | 0.62 | 0.86 | 0.45 | 0.39 | 0.43 | 0.19 | 0.34 | 0.34 | CGGAATAAAACCACT GAAACACAATCAGG GCTACGTGCATTACC TGTGGC (SEQ ID NO: 870) |

TABLE 4C-continued

CD8 positive T-Cell Markers

| | | | | | | | | | | |
|---|---|---|---|---|---|---|---|---|---|---|
| TEMRA_nm53 | 0.70 | 0.71 | 0.88 | 0.38 | 0.52 | 0.56 | 0.14 | 0.50 | 0.45 | CGGATGCCTATCTGT TCCTGACCCCCAAGG TCCCTCAGGATCTGC TGGGA (SEQ ID NO: 871) |
| TEMRA_nm54 | 0.73 | 0.74 | 0.87 | 0.57 | 0.65 | 0.54 | 0.17 | 0.59 | 0.52 | CGCAAATCCAAACCA TATCAGGGTTTCACA GCTAGAGAGAAGGA GTCAAT (SEQ ID NO: 872) |
| TEMRA_nm55 | 0.79 | 0.65 | 0.88 | 0.39 | 0.54 | 0.44 | 0.22 | 0.30 | 0.43 | GGTGATTACAGCAGA TGACCCCATCTGCCT GGTGCCTGACTTTAT TTTCG (SEQ ID NO: 873) |
| TEMRA_nm56 | 0.65 | 0.71 | 0.87 | 0.46 | 0.59 | 0.43 | 0.14 | 0.42 | 0.42 | GGGGTTGACCATGGC TGGTAACAGGGGACT CTGGTTGGCCAGTGG CATCG (SEQ ID NO: 874) |
| TEMRA_nm57 | 0.72 | 0.76 | 0.89 | 0.69 | 0.72 | 0.53 | 0.17 | 0.44 | 0.43 | CGAGTTTAACCCCAC TTGGAGCCAGAAAG ATGGGCCAAATCAAC ACCAAG (SEQ ID NO: 875) |
| TEMRA_nm58 | 0.85 | 0.74 | 0.89 | 0.54 | 0.49 | 0.44 | 0.22 | 0.31 | 0.34 | CACAGACTAATGATA ATCTTTGGGAAATTT GGGTCTACCATAAAT ACTCG (SEQ ID NO: 876) |
| TEMRA_nm59 | 0.72 | 0.70 | 0.86 | 0.54 | 0.69 | 0.55 | 0.17 | 0.41 | 0.51 | AGGTTAAAACCAAG GGCTCAGACTACAGG TGTGTGTAGCATGTG TACACG (SEQ ID NO: 877) |
| TEMRA_nm60 | 0.70 | 0.69 | 0.83 | 0.50 | 0.63 | 0.47 | 0.14 | 0.40 | 0.41 | TTCACTGCAGATGAA ATGGGCTTCTCATGC TACCTCAGTTACCAG AATCG (SEQ ID NO: 878) |
| TEMRA_nm61 | 0.82 | 0.59 | 0.87 | 0.34 | 0.37 | 0.37 | 0.19 | 0.24 | 0.26 | CGCATACTTTCAGGG AGAGGCACTATTCTT GGCTTTAAGTTCATG AGTAA (SEQ ID NO: 879) |
| TEMRA_nm62 | 0.66 | 0.72 | 0.88 | 0.44 | 0.65 | 0.47 | 0.16 | 0.38 | 0.40 | CGACAATTTCAATCC AGAGTGTTAAGTGCT GTTACAGAGGAGCTG GGGAG (SEQ ID NO: 880) |
| TEMRA_nm63 | 0.73 | 0.75 | 0.87 | 0.60 | 0.67 | 0.59 | 0.17 | 0.45 | 0.45 | CGTAGTCTGACACAG GAGTCCACTTAGCCA TTGATCTGTGTGGCT CAATT (SEQ ID NO: 881) |
| TEMRA_nm64 | 0.64 | 0.61 | 0.91 | 0.35 | 0.35 | 0.36 | 0.13 | 0.20 | 0.21 | GACTGAAACTTGCAC CAGTTCTGAATGCCT CTAACCTTGGTTGTA TAACG (SEQ ID NO: 882) |
| TEMRA_nm65 | 0.78 | 0.75 | 0.93 | 0.49 | 0.60 | 0.50 | 0.20 | 0.48 | 0.40 | CGAGGCTGAATGAA ATCCAATTGGAACTC ACTTGAACACTGTTT TGATGT (SEQ ID NO: 883) |
| TEMRA_nm66 | 0.66 | 0.76 | 0.87 | 0.47 | 0.51 | 0.49 | 0.16 | 0.44 | 0.40 | GTGTCCCAGGAAAG GCCCACTAGTGGGTC CCGGTGTGGGACCCA CCCCCG (SEQ ID NO: 884) |
| TEMRA_nm67 | 0.65 | 0.67 | 0.83 | 0.45 | 0.45 | 0.40 | 0.13 | 0.36 | 0.37 | ACAGTGAGCTATGCC CTGAATGACAGACAC CATATTCACAGGCAA AATCG (SEQ ID NO: 885) |

TABLE 4D

Follicular helper T cells - marker

| Marker-ID | TargetID | SYMBOL | Accession | Basophil Granulocytes | Eosinophil Granulocytes | Neutrophil Granulocytes | Classical Monocytes | Non-Classical Monocytes | NK classical |
|---|---|---|---|---|---|---|---|---|---|
| TFH_nm1 | cg13077150 | PRKCZ | NM_002744 | 0.91 | 0.90 | 0.91 | 0.89 | 0.89 | 0.88 |
| TFH_nm2 | cg11227141 | PRKCZ | NM_002744 | 0.86 | 0.82 | 0.83 | 0.86 | 0.85 | 0.87 |
| TFH_nm3 | cg27064482 | MKL2 | NM_014048 | 0.85 | 0.87 | 0.89 | 0.89 | 0.88 | 0.84 |
| TFH_nm4 | cg21377860 | GIMAP8 | NM_175571 | 0.92 | 0.91 | 0.91 | 0.92 | 0.91 | 0.92 |
| TFH_nm5 | cg15722603 | LIF | NM_002309 | 0.88 | 0.89 | 0.90 | 0.89 | 0.90 | 0.80 |
| TFH_nm6 | cg00151768 | NFATC1 | NM_006162 | 0.90 | 0.91 | 0.91 | 0.93 | 0.87 | 0.91 |
| TFH_nm7 | cg15260951 | NFATC1 | NM_006162 | 0.94 | 0.95 | 0.95 | 0.95 | 0.95 | 0.92 |
| TFH_nm8 | cg16421411 | C2orf48 | NM_182626 | 0.97 | 0.96 | 0.97 | 0.96 | 0.97 | 0.96 |
| TFH_nm9 | cg26396261 | ATXN1 | NM_000332 | 0.97 | 0.95 | 0.96 | 0.97 | 0.97 | 0.96 |
| TFH_nm10 | cg10842070 | DNAJC5 | NM_025219 | 0.97 | 0.98 | 0.97 | 0.97 | 0.97 | 0.95 |
| TFH_nm11 | cg09232021 | MAF | NM_175571 | 0.92 | 0.91 | 0.91 | 0.93 | 0.92 | 0.91 |
| TFH_nm12 | cg13144059 | SPATS2L | NM_015535 | 0.96 | 0.97 | 0.98 | 0.98 | 0.97 | 0.97 |
| TFH_nm13 | cg26175815 | TMCC1 | NM_001017395 | 0.90 | 0.90 | 0.92 | 0.90 | 0.88 | 0.88 |
| TFH_nm14 | cg07172701 | SERINC5 | NM_178276 | 0.91 | 0.78 | 0.84 | 0.84 | 0.87 | 0.90 |
| TFH_nm15 | cg21911000 | CD28 | NM_006139 | 0.88 | 0.86 | 0.89 | 0.91 | 0.89 | 0.89 |
| TFH_nm16 | cg15213399 | LPP | NM_005578 | 0.92 | 0.92 | 0.91 | 0.90 | 0.87 | 0.89 |
| TFH_nm17 | cg03596635 | ABTB1 | NM_172028 | 0.95 | 0.94 | 0.95 | 0.95 | 0.95 | 0.94 |
| TFH_nm18 | cg10451262 | ZHX1 | NM_007222 | 0.91 | 0.91 | 0.92 | 0.90 | 0.91 | 0.91 |
| TFH_nm19 | cg01349034 | — | — | 0.90 | 0.89 | 0.88 | 0.88 | 0.86 | 0.87 |
| TFH_nm20 | cg15873449 | PTPN2 | NM_080423 | 0.85 | 0.86 | 0.87 | 0.88 | 0.85 | 0.86 |
| TFH_nm21 | cg16152136 | — | — | 0.85 | 0.89 | 0.90 | 0.88 | 0.89 | 0.88 |
| TFH_nm22 | cg20968717 | LIPC | NM_000236 | 0.90 | 0.92 | 0.92 | 0.94 | 0.92 | 0.91 |
| TFH_nm23 | cg25087423 | CXCR5 | NM_001716 | 0.90 | 0.92 | 0.92 | 0.91 | 0.90 | 0.86 |
| TFH_nm24 | cg08012294 | CTSB | NM_147780 | 0.88 | 0.92 | 0.92 | 0.86 | 0.76 | 0.91 |
| TFH_nm25 | cg17410313 | NUB1 | NM_016118 | 0.92 | 0.91 | 0.92 | 0.91 | 0.89 | 0.92 |
| TFH_nm26 | cg04337734 | SCL25A12 | NM_003705 | 0.89 | 0.91 | 0.87 | 0.88 | 0.87 | 0.86 |
| TFH_nm27 | cg15039797 | HIPK2 | NM_022740 | 0.97 | 0.97 | 0.98 | 0.97 | 0.98 | 0.25 |
| TFH_nm28 | cg27586885 | — | — | 0.96 | 0.95 | 0.96 | 0.96 | 0.95 | 0.94 |
| TFH_nm29 | cg20702205 | RNF216 | NM_207111 | 0.91 | 0.86 | 0.91 | 0.89 | 0.87 | 0.91 |
| TFH_nm30 | cg06846719 | FAM6A | NM_021238 | 0.87 | 0.88 | 0.90 | 0.89 | 0.87 | 0.87 |
| TFH_nm31 | cg23892568 | CLEC7A | NM_022570 | 0.87 | 0.88 | 0.88 | 0.81 | 0.82 | 0.86 |
| TFH_nm32 | cg24033742 | — | — | 0.90 | 0.90 | 0.90 | 0.90 | 0.90 | 0.90 |
| TFH_nm33 | cg03280299 | ST7 | NM_018412 | 0.82 | 0.88 | 0.89 | 0.84 | 0.86 | 0.87 |
| TFH_nm34 | cg16375820 | IL6ST | NM_175767 | 0.89 | 0.86 | 0.88 | 0.87 | 0.87 | 0.88 |
| TFH_nm35 | cg11307417 | ZNF589 | NM_016089 | 0.88 | 0.90 | 0.90 | 0.87 | 0.87 | 0.89 |
| TFH_nm36 | cg13774342 | DLEU1 | — | 0.90 | 0.92 | 0.90 | 0.88 | 0.91 | 0.89 |
| TFH_nm37 | cg21653149 | ANKFY1 | NM_016376 | 0.91 | 0.91 | 0.91 | 0.91 | 0.92 | 0.88 |
| TFH_nm38 | cg14624950 | SMURF2 | NM_022739 | 0.87 | 0.89 | 0.90 | 0.90 | 0.89 | 0.87 |
| TFH_nm39 | cg13142152 | FAM65B | — | 0.67 | 0.78 | 0.86 | 0.87 | 0.85 | 0.85 |
| TFH_nm40 | cg15873112 | ATXN7L1 | NM_020725 | 0.78 | 0.80 | 0.84 | 0.87 | 0.85 | 0.86 |
| TFH_nm41 | cg23342358 | PCBP | — | 0.84 | 0.80 | 0.76 | 0.84 | 0.83 | 0.86 |
| TFH_nm42 | cg22535163 | — | — | 0.91 | 0.90 | 0.90 | 0.91 | 0.90 | 0.89 |
| TFH_nm43 | cg13637151 | PRRC2B | NM_013318 | 0.92 | 0.92 | 0.93 | 0.91 | 0.91 | 0.90 |
| TFH_nm44 | cg26446535 | ARHGAP35 | NM_004491 | 0.90 | 0.88 | 0.90 | 0.92 | 0.93 | 0.91 |
| TFH_nm45 | cg06346099 | SOD2 | NM_000636 | 0.47 | 0.63 | 0.79 | 0.84 | 0.77 | 0.78 |
| TFH_nm46 | cg13049261 | SETD3 | NM_032233 | 0.93 | 0.92 | 0.93 | 0.93 | 0.92 | 0.90 |
| TFH_nm47 | cg06019273 | ARID1B | NM_017519 | 0.85 | 0.88 | 0.91 | 0.88 | 0.88 | 0.84 |
| TFH_nm48 | cg00780520 | PVT1 | NR_003367 | 0.80 | 0.78 | 0.80 | 0.81 | 0.85 | 0.82 |
| TFH_nm49 | cg07167688 | — | — | 0.95 | 0.96 | 0.95 | 0.96 | 0.94 | 0.95 |
| TFH_nm50 | cg27168844 | IL17A | NM_002190 | 0.69 | 0.89 | 0.92 | 0.92 | 0.89 | 0.87 |
| TFH_nm51 | cg18883472 | CNIH4 | NM_014184 | 0.91 | 0.92 | 0.91 | 0.92 | 0.91 | 0.89 |
| TFH_nm52 | cg11887733 | — | — | 0.85 | 0.90 | 0.90 | 0.92 | 0.89 | 0.88 |
| TFH_nm53 | cg02003272 | — | — | 0.96 | 0.96 | 0.96 | 0.97 | 0.96 | 0.96 |
| TFH_nm54 | cg20298778 | PHACTR2 | NR_027113 | 0.90 | 0.92 | 0.94 | 0.92 | 0.89 | 0.86 |
| TFH_nm55 | cg19030737 | ITPKB | NM_002221 | 0.74 | 0.67 | 0.83 | 0.81 | 0.84 | 0.79 |
| TFH_nm56 | cg19324997 | HDAC4 | NM_006037 | 0.98 | 0.97 | 0.98 | 0.98 | 0.97 | 0.79 |

| Marker-ID | NK bright | B-Cells | MDSC | CD4+ Th naive | CD4+ act. | CD4+ Th1 | CD4+ Th2 | CD4+ Th Central Mem. | CD4+ Th Effect. Mem. | CD4+ NK T cells |
|---|---|---|---|---|---|---|---|---|---|---|
| TFH_nm1 | 0.87 | 0.86 | 0.85 | 0.92 | 0.33 | 0.63 | 0.51 | 0.55 | 0.54 | 0.78 |
| TFH_nm2 | 0.88 | 0.83 | 0.81 | 0.89 | 0.28 | 0.60 | 0.42 | 0.58 | 0.57 | 0.78 |
| TFH_nm3 | 0.68 | 0.80 | 0.17 | 0.89 | 0.17 | 0.66 | 0.59 | 0.62 | 0.63 | 0.56 |
| TFH_nm4 | 0.89 | 0.92 | 0.90 | 0.79 | 0.38 | 0.73 | 0.51 | 0.72 | 0.71 | 0.83 |
| TFH_nm5 | 0.80 | 0.88 | 0.84 | 0.89 | 0.24 | 0.35 | 0.42 | 0.47 | 0.44 | 0.58 |
| TFH_nm6 | 0.82 | 0.81 | 0.88 | 0.92 | 0.37 | 0.71 | 0.65 | 0.80 | 0.74 | 0.74 |
| TFH_nm7 | 0.88 | 0.82 | 0.92 | 0.90 | 0.14 | 0.29 | 0.26 | 0.38 | 0.29 | 0.55 |
| TFH_nm8 | 0.95 | 0.96 | 0.93 | 0.97 | 0.44 | 0.68 | 0.59 | 0.69 | 0.69 | 0.80 |
| TFH_nm9 | 0.94 | 0.97 | 0.96 | 0.96 | 0.33 | 0.87 | 0.79 | 0.87 | 0.85 | 0.87 |
| TFH_nm10 | 0.90 | 0.50 | 0.94 | 0.97 | 0.29 | 0.87 | 0.80 | 0.86 | 0.87 | 0.89 |
| TFH_nm11 | 0.90 | 0.91 | 0.90 | 0.91 | 0.25 | 0.56 | 0.62 | 0.53 | 0.47 | 0.65 |

TABLE 4D-continued

Follicular helper T cells - marker

| TFH_nm12 | 0.95 | 0.90 | 0.96 | 0.97 | 0.42 | 0.88 | 0.80 | 0.91 | 0.85 | 0.88 |
|---|---|---|---|---|---|---|---|---|---|---|
| TFH_nm13 | 0.81 | 0.78 | 0.88 | 0.87 | 0.25 | 0.54 | 0.49 | 0.60 | 0.56 | 0.75 |
| TFH_nm14 | 0.92 | 0.88 | 0.84 | 0.93 | 0.25 | 0.63 | 0.45 | 0.57 | 0.62 | 0.75 |
| TFH_nm15 | 0.88 | 0.91 | 0.87 | 0.85 | 0.15 | 0.38 | 0.32 | 0.41 | 0.25 | 0.62 |
| TFH_nm16 | 0.76 | 0.90 | 0.84 | 0.91 | 0.36 | 0.88 | 0.77 | 0.85 | 0.86 | 0.67 |
| TFH_nm17 | 0.93 | 0.92 | 0.91 | 0.54 | 0.29 | 0.62 | 0.58 | 0.57 | 0.58 | 0.72 |
| TFH_nm18 | 0.91 | 0.87 | 0.89 | 0.90 | 0.22 | 0.49 | 0.37 | 0.55 | 0.45 | 0.65 |
| TFH_nm19 | 0.87 | 0.93 | 0.88 | 0.91 | 0.36 | 0.73 | 0.74 | 0.76 | 0.70 | 0.78 |
| TFH_nm20 | 0.76 | 0.57 | 0.85 | 0.82 | 0.18 | 0.56 | 0.54 | 0.52 | 0.52 | 0.73 |
| TFH_nm21 | 0.88 | 0.86 | 0.87 | 0.83 | 0.20 | 0.40 | 0.50 | 0.45 | 0.42 | 0.60 |
| TFH_nm22 | 0.87 | 0.72 | 0.89 | 0.85 | 0.36 | 0.63 | 0.54 | 0.64 | 0.62 | 0.76 |
| TFH_nm23 | 0.81 | 0.08 | 0.85 | 0.83 | 0.19 | 0.59 | 0.52 | 0.58 | 0.58 | 0.68 |
| TFH_nm24 | 0.89 | 0.89 | 0.80 | 0.81 | 0.23 | 0.46 | 0.49 | 0.50 | 0.45 | 0.68 |
| TFH_nm25 | 0.89 | 0.81 | 0.89 | 0.92 | 0.31 | 0.66 | 0.65 | 0.66 | 0.65 | 0.77 |
| TFH_nm26 | 0.78 | 0.86 | 0.86 | 0.84 | 0.28 | 0.74 | 0.62 | 0.65 | 0.61 | 0.63 |
| TFH_nm27 | 0.62 | 0.98 | 0.91 | 0.10 | 0.21 | 0.52 | 0.58 | 0.44 | 0.45 | 0.51 |
| TFH_nm28 | 0.92 | 0.94 | 0.89 | 0.95 | 0.32 | 0.81 | 0.55 | 0.72 | 0.69 | 0.71 |
| TFH_nm29 | 0.90 | 0.79 | 0.89 | 0.89 | 0.29 | 0.80 | 0.58 | 0.70 | 0.78 | 0.86 |
| TFH_nm30 | 0.76 | 0.75 | 0.83 | 0.87 | 0.24 | 0.58 | 0.44 | 0.59 | 0.59 | 0.63 |
| TFH_nm31 | 0.79 | 0.67 | 0.81 | 0.86 | 0.17 | 0.38 | 0.35 | 0.43 | 0.29 | 0.63 |
| TFH_nm32 | 0.91 | 0.92 | 0.89 | 0.91 | 0.41 | 0.72 | 0.67 | 0.74 | 0.77 | 0.84 |
| TFH_nm33 | 0.78 | 0.84 | 0.85 | 0.86 | 0.33 | 0.62 | 0.52 | 0.60 | 0.61 | 0.66 |
| TFH_nm34 | 0.77 | 0.88 | 0.80 | 0.18 | 0.25 | 0.69 | 0.47 | 0.56 | 0.66 | 0.65 |
| TFH_nm35 | 0.87 | 0.86 | 0.85 | 0.36 | 0.24 | 0.57 | 0.41 | 0.43 | 0.54 | 0.64 |
| TFH_nm36 | 0.82 | 0.81 | 0.88 | 0.89 | 0.21 | 0.45 | 0.35 | 0.40 | 0.39 | 0.55 |
| TFH_nm37 | 0.76 | 0.90 | 0.86 | 0.85 | 0.38 | 0.70 | 0.70 | 0.70 | 0.70 | 0.60 |
| TFH_nm38 | 0.82 | 0.87 | 0.85 | 0.90 | 0.31 | 0.61 | 0.44 | 0.60 | 0.52 | 0.77 |
| TFH_nm39 | 0.82 | 0.83 | 0.81 | 0.69 | 0.19 | 0.42 | 0.31 | 0.40 | 0.33 | 0.67 |
| TFH_nm40 | 0.86 | 0.50 | 0.81 | 0.67 | 0.19 | 0.48 | 0.35 | 0.39 | 0.41 | 0.54 |
| TFH_nm41 | 0.85 | 0.87 | 0.83 | 0.78 | 0.34 | 0.71 | 0.60 | 0.70 | 0.72 | 0.74 |
| TFH_nm42 | 0.85 | 0.91 | 0.89 | 0.73 | 0.31 | 0.65 | 0.60 | 0.68 | 0.53 | 0.68 |
| TFH_nm43 | 0.87 | 0.92 | 0.88 | 0.83 | 0.35 | 0.76 | 0.65 | 0.69 | 0.73 | 0.71 |
| TFH_nm44 | 0.87 | 0.90 | 0.89 | 0.92 | 0.38 | 0.65 | 0.74 | 0.69 | 0.63 | 0.72 |
| TFH_nm45 | 0.78 | 0.85 | 0.77 | 0.86 | 0.24 | 0.45 | 0.45 | 0.48 | 0.44 | 0.64 |
| TFH_nm46 | 0.89 | 0.90 | 0.87 | 0.76 | 0.23 | 0.48 | 0.41 | 0.47 | 0.42 | 0.65 |
| TFH_nm47 | 0.82 | 0.62 | 0.87 | 0.90 | 0.32 | 0.54 | 0.46 | 0.60 | 0.60 | 0.66 |
| TFH_nm48 | 0.80 | 0.65 | 0.77 | 0.87 | 0.20 | 0.42 | 0.27 | 0.44 | 0.37 | 0.61 |
| TFH_nm49 | 0.95 | 0.94 | 0.93 | 0.96 | 0.31 | 0.53 | 0.47 | 0.57 | 0.50 | 0.69 |
| TFH_nm50 | 0.80 | 0.70 | 0.86 | 0.88 | 0.24 | 0.72 | 0.61 | 0.62 | 0.60 | 0.63 |
| TFH_nm51 | 0.87 | 0.93 | 0.89 | 0.76 | 0.41 | 0.76 | 0.47 | 0.64 | 0.71 | 0.83 |
| TFH_nm52 | 0.83 | 0.89 | 0.83 | 0.58 | 0.23 | 0.40 | 0.39 | 0.40 | 0.44 | 0.66 |
| TFH_nm53 | 0.94 | 0.89 | 0.92 | 0.96 | 0.35 | 0.58 | 0.50 | 0.55 | 0.57 | 0.66 |
| TFH_nm54 | 0.79 | 0.73 | 0.89 | 0.92 | 0.39 | 0.79 | 0.62 | 0.79 | 0.71 | 0.68 |
| TFH_nm55 | 0.82 | 0.82 | 0.80 | 0.41 | 0.28 | 0.68 | 0.48 | 0.52 | 0.59 | 0.63 |
| TFH_nm56 | 0.94 | 0.98 | 0.93 | 0.73 | 0.41 | #DIV/0! | #DIV/0! | 0.70 | 0.68 | 0.72 |

| Marker-ID | CD4+ TFH | CD8+ Cyto-toxic T-Cells | CD8+ naive T8n_1 | CD8+ act. | CD8+ Th Central Mem. | CD8+ Th Effect. Mem. | TEMRA | CD8+ NK T cells | NK T-Cells | Discovery Fragment |
|---|---|---|---|---|---|---|---|---|---|---|
| THF_nm1 | 0.23 | 0.86 | 0.86 | 0.68 | 0.77 | 0.82 | 0.86 | 0.87 | 0.86 | CGTGCTGTGCCCTCGATGCTCCAGCACCTATGGCCCTGCTGACCCTGGAG (SEQ ID NO: 886) |
| THF_nm2 | 0.18 | 0.81 | 0.85 | 0.67 | 0.73 | 0.74 | 0.72 | 0.75 | 0.67 | CGAGGCACGGCCACTTCTCCAAAGGGCCAAGCTTCCCTCGTCAGGCGGCT (SEQ ID NO: 887) |
| THF_nm3 | 0.08 | 0.88 | 0.82 | 0.70 | 0.66 | 0.76 | 0.81 | 0.78 | 0.82 | AGAGAGCTGACAAGGGCATGCACGATTAATTGCACACTCGCACACCCACG (SEQ ID NO: 888) |
| THF_nm4 | 0.28 | 0.88 | 0.88 | 0.81 | 0.90 | 0.88 | 0.92 | 0.91 | 0.93 | CGTAAAGTCTGCTCCAAAGATGGCCTCCAGTTTCGCCACAGCTGTTTTGT (SEQ ID NO: 889) |

TABLE 4D-continued

| Follicular helper T cells - marker | | | | | | | | | | |
|---|---|---|---|---|---|---|---|---|---|---|
| THF_nm5 | 0.13 | 0.78 | 0.89 | 0.64 | 0.71 | 0.62 | 0.73 | 0.65 | 0.60 | CGGGACCAGAA GATCCTCAACCC CAGTGCCCTCAG CCTCCACAGCAA GCT (SEQ ID NO: 890) |
| THF_nm6 | 0.23 | 0.92 | 0.85 | 0.86 | 0.86 | 0.90 | 0.88 | 0.90 | 0.90 | CGGCTCTTCAGG TACAGAGATCTG AACTTGGAAAGA CCTGCCTTTCTA AA (SEQ ID NO: 891) |
| THF_nm7 | 0.10 | 0.87 | 0.91 | 0.63 | 0.66 | 0.73 | 0.93 | 0.81 | 0.85 | CGGCTCGCTCAG CCATCAGGTGCC CCACGACACACA GGTGGTTTGGGG GT (SEQ ID NO: 892) |
| THF_nm8 | 0.32 | 0.97 | 0.95 | 0.87 | 0.93 | 0.95 | 0.95 | 0.94 | 0.97 | CGCCCGTCGTTC ATGTCGATTCTC TCAGTCAATCAA AACGCTGCCACA GC (SEQ ID NO: 893) |
| THF_nm9 | 0.16 | 0.96 | 0.94 | 0.93 | 0.93 | 0.94 | 0.96 | 0.96 | 0.96 | ATGCAGCGATGT GGCCGGGAGTTA GCATGAAGCGTG GTTATTCTATCA CG (SEQ ID NO: 894) |
| THF_nm10 | 0.16 | 0.97 | 0.95 | 0.85 | 0.90 | 0.93 | 0.96 | 0.94 | 0.97 | CGCTGTCCGCCC TTCGCCACCCAC CGCGCCTGCTGC TCAGGAATGTTC CA (SEQ ID NO: 895) |
| THF_nm11 | 0.10 | 0.90 | 0.91 | 0.85 | 0.88 | 0.62 | 0.91 | 0.79 | 0.73 | TGTTTCTCTTTAC CGTTCAATGCAT ATGTGCGCAAGC CACCTCTGATGC G (SEQ ID NO: 896) |
| THF_nm12 | 0.24 | 0.98 | 0.96 | 0.94 | 0.95 | 0.97 | 0.98 | 0.96 | 0.97 | GGCAGAGTCATC TGCGTGGCGCAC ACTGTTGTATAT GCTGCACGTACA CG (SEQ ID NO: 897) |
| THF_nm13 | 0.12 | 0.84 | 0.84 | 0.78 | 0.72 | 0.81 | 0.84 | 0.87 | 0.84 | GCTTTCTCATTTT TCCGTTCCTCCA CCCACTGGCTGG TTATGGGGGTTC G (SEQ ID NO: 898) |
| THF_nm14 | 0.12 | 0.88 | 0.90 | 0.79 | 0.82 | 0.87 | 0.88 | 0.77 | 0.88 | CGTACTTGCAAA GTAATACAGAAA CGTGACTTTCGG CAGCTACCCAAG AT (SEQ ID NO: 899) |
| THF_nm15 | 0.09 | 0.82 | 0.87 | 0.61 | 0.77 | 0.60 | 0.87 | 0.79 | 0.78 | CGGTTAATTATG GAAAAACAGCTT GTTAAGCAAATG CTAATGTAAGAA GA (SEQ ID NO: 900) |
| THF_nm16 | 0.15 | 0.93 | 0.90 | 0.90 | 0.74 | 0.84 | 0.87 | 0.80 | 0.94 | GTTTTAATAAAG CACTATCAAAAA GACGGCACAGA GTTTCGGTTGCC ACG (SEQ ID NO: 901) |
| THF_nm17 | 0.15 | 0.61 | 0.50 | 0.77 | 0.84 | 0.84 | 0.87 | 0.88 | 0.87 | AGAGGAATCGTG GTGCTTTGCAAA TGTGTATCAAGG CCTTTGAATGCA CG (SEQ ID NO: 902) |

TABLE 4D-continued

| Follicular helper T cells - marker | | | | | | | | | | |
|---|---|---|---|---|---|---|---|---|---|---|
| THF_nm18 | 0.12 | 0.82 | 0.90 | 0.68 | 0.77 | 0.77 | 0.69 | 0.72 | 0.75 | AAGAAATCCACT AATGAGTGTTCA CTAGCACAGGCA CATTTATGTTTTC G (SEQ ID NO: 903) |
| THF_nm19 | 0.16 | 0.88 | 0.91 | 0.82 | 0.84 | 0.82 | 0.84 | 0.84 | 0.81 | ACTGCACATATC TTTTTGAAAGAC AGCTTTTTAAGG TATGACTCACTA CG (SEQ ID NO: 904) |
| THF_nm20 | 0.11 | 0.89 | 0.86 | 0.71 | 0.78 | 0.76 | 0.84 | 0.86 | 0.81 | CGCCAAGTATTC AGCATCTCTTTG GAATTCATTTGT CAGCCTCTCTGG TT (SEQ ID NO: 905) |
| THF_nm21 | 0.10 | 0.83 | 0.85 | 0.70 | 0.80 | 0.68 | 0.80 | 0.69 | 0.68 | CGTCAAGCTGGC AGAATTTTAGAG GCATCTCATTTA AATTAGATCTGG CC (SEQ ID NO: 906) |
| THF_nm22 | 0.16 | 0.86 | 0.89 | 0.73 | 0.83 | 0.80 | 0.89 | 0.90 | 0.89 | CGGGTGACTCAT AGAGAGTGATTA GAAGTAAAAAG GTTCTGGAAATT CCC (SEQ ID NO: 907) |
| THF_nm23 | 0.10 | 0.84 | 0.82 | 0.54 | 0.81 | 0.77 | 0.83 | 0.85 | 0.81 | TGATGAGTTGTG AGGCAGGTCGCG GCCCTACTGCCT CAGGAGACGATG CG (SEQ ID NO: 908) |
| THF_nm24 | 0.15 | 0.90 | 0.89 | 0.85 | 0.91 | 0.88 | 0.89 | 0.90 | 0.88 | CGCCTAACCAGT TGGAAACAGGGC TGTCCTGAGCCA ACACCCAGGAGA GC (SEQ ID NO: 909) |
| THF_nm25 | 0.19 | 0.89 | 0.89 | 0.84 | 0.89 | 0.87 | 0.87 | 0.89 | 0.84 | CGGTAGAGTCTA ATTTGCAAGATG TAAATGCAGAAA ATAGACATTTCA GC (SEQ ID NO: 910) |
| THF_nm26 | 0.15 | 0.87 | 0.84 | 0.84 | 0.79 | 0.77 | 0.82 | 0.81 | 0.81 | CGACGGACACTA AAACTGGGTCAG AAAACTTGGGTT CTAAACTCCTGT GC (SEQ ID NO: 911) |
| THF_nm27 | 0.09 | 0.60 | 0.60 | 0.87 | 0.87 | 0.83 | 0.96 | 0.87 | 0.85 | CGGTACCATGAT ACGTGCCGCAGA ATGTTCCTGCTG CGACCGTAAAGA AC (SEQ ID NO: 912) |
| THF_nm28 | 0.20 | 0.91 | 0.93 | 0.74 | 0.81 | 0.80 | 0.84 | 0.77 | 0.83 | CGCCCGCGCCTT TCCCAGGCTCAA GGCCTCCCTGCC CACCAGGCAGGT GG (SEQ ID NO: 913) |
| THF_nm29 | 0.21 | 0.90 | 0.88 | 0.85 | 0.90 | 0.89 | 0.90 | 0.89 | 0.90 | CACTAGTAACTC TCCGGTGTCTAG AGTTAGTACTGA TGGACTCCCTGC CG (SEQ ID NO: 914) |
| THF_nm30 | 0.12 | 0.80 | 0.84 | 0.69 | 0.59 | 0.77 | 0.69 | 0.82 | 0.76 | CGCTGAGATTGT TTGAGTTGTTTT CTTAATTAGTAT TTCATAGCTAAG T (SEQ ID NO: 915) |

TABLE 4D-continued

| Follicular helper T cells - marker | | | | | | | | | | |
|---|---|---|---|---|---|---|---|---|---|---|
| THF_nm31 | 0.11 | 0.85 | 0.87 | 0.79 | 0.80 | 0.69 | 0.83 | 0.81 | 0.80 | CGGTTAAATTAA TTAATGTCAGAC TTAGTTGTGAGA GTAATGAAGGCA GC (SEQ ID NO: 916) |
| THF_nm32 | 0.22 | 0.90 | 0.89 | 0.79 | 0.87 | 0.90 | 0.89 | 0.88 | 0.90 | CGCTGGGAGAAC TTGAGCGGGGAG CCCAGCACCACA CACCCACTTGCC TC (SEQ ID NO: 917) |
| THF_nm33 | 0.16 | 0.85 | 0.80 | 0.82 | 0.69 | 0.77 | 0.85 | 0.81 | 0.83 | CTGCTCTAGGAA TATATTTACATA CATGTATTTCTC CTATTTCTTCATC G (SEQ ID NO: 918) |
| THF_nm34 | 0.14 | 0.72 | 0.59 | 0.81 | 0.76 | 0.84 | 0.84 | 0.86 | 0.90 | CGGGGAATCCCT CCCTGCCACTGT AGAGGATTTATG GGTTGCCCTTAA GT (SEQ ID NO: 919) |
| THF_nm35 | 0.16 | 0.73 | 0.69 | 0.77 | 0.82 | 0.83 | 0.89 | 0.86 | 0.87 | GAGTGTATCCTC TGATGTACACTA AGAGCGGACTTG AGGCTAAAGTTT CG (SEQ ID NO: 920) |
| THF_nm36 | 0.13 | 0.81 | 0.89 | 0.61 | 0.69 | 0.66 | 0.60 | 0.62 | 0.63 | TGGGAGACTTGT AATTGTGTACCT GTTTGCATTGTTT AGCCTATGCATC G (SEQ ID NO: 921) |
| THF_nm37 | 0.19 | 0.86 | 0.85 | 0.78 | 0.72 | 0.77 | 0.84 | 0.80 | 0.79 | CGGTGCTTGAGG AAGATGCATCTG CTCTTGACACTG ACATACTCGAAG GA (SEQ ID NO: 922) |
| THF_nm38 | 0.18 | 0.85 | 0.86 | 0.76 | 0.77 | 0.78 | 0.76 | 0.73 | 0.76 | CGGCATCCGAAT ATTCTAGCCCTG GCAGACCTCTTA GCTGCTTTGTTG AT (SEQ ID NO: 923) |
| THF_nm39 | 0.13 | 0.84 | 0.81 | 0.65 | 0.81 | 0.76 | 0.74 | 0.74 | 0.79 | TCCCAATCAGTG AGACCTCAAATA ATGAACTTGGCT CTCATTTATACA CG (SEQ ID NO: 924) |
| THF_nm40 | 0.12 | 0.79 | 0.87 | 0.73 | 0.79 | 0.69 | 0.73 | 0.71 | 0.65 | ATTCAAAGACGC TTGCTCTGAAAG CCCGAAATTCAG TCTTTCTGAAGA CG (SEQ ID NO: 925) |
| THF_nm41 | 0.19 | 0.83 | 0.83 | 0.78 | 0.77 | 0.80 | 0.83 | 0.81 | 0.80 | TACCAGAGTGCC TGTGCTGTTGTA TCCTGACACACC AGGTACTGCATA CG (SEQ ID NO: 926) |
| THF_nm42 | 0.23 | 0.85 | 0.82 | 0.84 | 0.84 | 0.83 | 0.90 | 0.86 | 0.81 | CGCACAAAAATG TAGAAAGAATAT TGGAGACGGAA AATTGTGAATGT ACC (SEQ ID NO: 927) |
| THF_nm43 | 0.25 | 0.90 | 0.86 | 0.83 | 0.85 | 0.86 | 0.89 | 0.87 | 0.90 | GGAAATCGAATC GTGGATTCACCA GGCCGGTGCTGG CACACTCACCCT CG (SEQ ID NO: 928) |

TABLE 4D-continued

| Follicular helper T cells - marker | | | | | | | | | |
|---|---|---|---|---|---|---|---|---|---|
| THF_nm44 | 0.25 | 0.89 | 0.86 | 0.81 | 0.82 | 0.80 | 0.84 | 0.85 | 0.85 | GTTGTCAGAATT TCCTTCCCTTTAA AGGCTGAATAGG CCAGGCGTGATC G (SEQ ID NO: 929) |
| THF_nm45 | 0.12 | 0.80 | 0.84 | 0.77 | 0.80 | 0.74 | 0.76 | 0.71 | 0.69 | CCACTACAAAAA CAGTCATAAAGA GCTTAACATACT CAGCATAACGAT CG (SEQ ID NO: 930) |
| THF_nm46 | 0.18 | 0.78 | 0.89 | 0.61 | 0.66 | 0.62 | 0.62 | 0.62 | 0.62 | CGATGGGTAGGT GGAATAACAGCC CCCTCCCAAAGC TTAGCAACAACA GC (SEQ ID NO: 931) |
| THF_nm47 | 0.18 | 0.81 | 0.83 | 0.74 | 0.71 | 0.77 | 0.78 | 0.78 | 0.79 | AGAATGGAAAAT GTAAATTAAGCC TTTGTTTTCCATC ATCATTCTCATC G (SEQ ID NO: 932) |
| THF_nm48 | 0.11 | 0.73 | 0.83 | 0.56 | 0.67 | 0.69 | 0.67 | 0.73 | 0.76 | CGCCACCTCCAT GCTGIGTTTCTG TGGCTGGAGCTT TTCTGCACTGGA AA (SEQ ID NO: 933) |
| THF_nm49 | 0.26 | 0.88 | 0.95 | 0.71 | 0.80 | 0.83 | 0.56 | 0.88 | 0.79 | TGCCTGAGGCCG CCCGCTGTTCAG CGGAAGAGCCA ACATCTGTGCTA TCG (SEQ ID NO: 934) |
| THF_nm50 | 0.19 | 0.84 | 0.87 | 0.76 | 0.81 | 0.62 | 0.78 | 0.66 | 0.63 | CGGTCCAGAAAT ACTATCTGGTCC AAATCAGCAAGA GCATCGCACGTT AG (SEQ ID NO: 935) |
| THF_nm51 | 0.26 | 0.85 | 0.85 | 0.85 | 0.89 | 0.87 | 0.89 | 0.89 | 0.89 | AATTACCCTCAT GATGAACATTTC CCTACTCTGAGT AAAGATGCTATC CG (SEQ ID NO: 936) |
| THF_nm52 | 0.17 | 0.76 | 0.88 | 0.58 | 0.69 | 0.66 | 0.76 | 0.80 | 0.75 | TAAATAAAGATC ATCTGGTCCAAG GATGGCAAATAT GTGGCACAAGTA CG (SEQ ID NO: 937) |
| THF_nm53 | 0.27 | 0.90 | 0.96 | 0.65 | 0.62 | 0.80 | 0.86 | 0.84 | 0.89 | AAGGCGCAGCCA AGGACTATTACA CCTCTGGCTGCT CGGACGCATCTT CG (SEQ ID NO: 938) |
| THF_nm54 | 0.23 | 0.86 | 0.91 | 0.67 | 0.74 | 0.74 | 0.90 | 0.76 | 0.78 | CGGGTGGCTGAA TGGAAAAACAA ATGGGGCTTCAC CTGTGACTCAGA CCA (SEQ ID NO: 939) |
| THF_nm55 | 0.16 | 0.69 | 0.60 | 0.69 | 0.63 | 0.82 | 0.85 | 0.79 | 0.86 | CGGCTCAGGGAGA CTGAAACATCCA AAGCCTGAATTG GTCCTTATATCA TG (SEQ ID NO: 940) |

TABLE 4D-continued

Follicular helper T cells - marker

| THF_nm56 | 0.29 | 0.91 | 0.84 | 0.87 | 0.81 | 0.85 | 0.97 | 0.89 | 0.92 | CGCCCCGCACGT ACTGTGTGCCTC GTTCTTTATCTGT GTTCGTTTATTC A (SEQ ID NO: 941) |

TABLE 4E

CD4 positive T cell Marker

| Marker-ID | TargetID | SYMBOL | Accession | Basophil Granulocytes | Eosinophil Granulocytes | Neutrophil Granulocytes | Classical Monocytes | Non-classical Monocytes |
|---|---|---|---|---|---|---|---|---|
| nCD4-nm1 | cg24885723 | CA6 | NM_001215 | 0.91 | 0.93 | 0.90 | 0.92 | 0.91 |
| nCD4_nm2 | cg26280976 | — | — | 0.92 | 0.92 | 0.94 | 0.93 | 0.92 |
| nCD4_nm3 | cg00912164 | — | — | 0.89 | 0.90 | 0.90 | 0.91 | 0.89 |
| nCD4_nm4 | cg04116345 | MANIC1 | NM_020379 | 0.89 | 0.87 | 0.88 | 0.88 | 0.88 |
| nCD4_nm5 | cg13484324 | — | — | 0.92 | 0.92 | 0.94 | 0.91 | 0.92 |
| nCD4_nm6 | cg10555744 | MANIC1 | NM_020379 | 0.88 | 0.90 | 0.93 | 0.91 | 0.92 |
| nCD4_nm7 | cg08639389 | STIM2 | NM_001169117 | 0.91 | 0.92 | 0.92 | 0.93 | 0.92 |
| nCD_meth1 | cg25737313 | — | — | 0.04 | 0.03 | 0.03 | 0.03 | 0.03 |
| nCD_meth1 | cg13921921 | ARHGEF2 | NM_004723 | 0.21 | 0.25 | 0.05 | 0.03 | 0.05 |
| nCD_meth1 | cg03290131 | DUSP5 | NM_004419 | 0.10 | 0.15 | 0.08 | 0.02 | 0.03 |
| nCD_meth1 | cg04742550 | ITGAX | NM_000887 | 0.00 | 0.01 | 0.01 | 0.01 | 0.01 |
| nCD_meth1 | cg21268578 | GGA1 | NM_001001560 | 0.03 | 0.03 | 0.04 | 0.03 | 0.02 |
| CD4mem_nm1 | cg11106864 | RAP1GDS1 | NM_001100427 | 0.80 | 0.92 | 0.88 | 0.89 | 0.89 |
| CD4mem_nm2 | cg08877853 | GPR63 | NM_001143957 | 0.85 | 0.85 | 0.89 | 0.88 | 0.90 |
| CD4mem_nm3 | cg14108380 | SDCCAG3 | NM_001039708 | 0.95 | 0.95 | 0.94 | 0.96 | 0.96 |
| CD4mem_nm4 | cg10328548 | SS18L1 | NM_198935 | 0.92 | 0.92 | 0.91 | 0.93 | 0.92 |
| CD4mem_nm5 | cg03188793 | TALDO1 | NM_006755 | 0.82 | 0.71 | 0.84 | 0.87 | 0.86 |
| CD4mem_nm6 | cg09187865 | — | — | 0.91 | 0.91 | 0.82 | 0.80 | 0.80 |
| CD4mem_nm7 | cg04936610 | FAM38A | NM_001142864 | 0.78 | 0.82 | 0.83 | 0.84 | 0.86 |
| CD4mem_nm8 | cg21685655 | PON2 | NM_000305 | 0.84 | 0.86 | 0.87 | 0.85 | 0.85 |
| CD4mem_nm9 | cg21132587 | ALLC | NM_018436 | 0.96 | 0.96 | 0.97 | 0.97 | 0.96 |
| CD4mem_nm10 | cg04026937 | HLA-DRB1 | NM_002124 | 0.78 | 0.76 | 0.74 | 0.76 | 0.72 |
| CD4mem_nm11 | cg18591489 | — | — | 0.91 | 0.91 | 0.91 | 0.90 | 0.89 |
| CD4mem_nm12 | cg26296371 | FARS2 | NM_006567 | 0.75 | 0.82 | 0.76 | 0.80 | 0.75 |
| CD4mem_nm13 | cg26899005 | HCFC1 | NM_005334 | 0.89 | 0.89 | 0.91 | 0.90 | 0.93 |
| CD4mem_nm14 | cg08299859 | — | — | 0.93 | 0.94 | 0.93 | 0.94 | 0.93 |
| CD4mem_nm15 | cg05450979 | NUBP1 | NM_002484 | 0.73 | 0.70 | 0.78 | 0.77 | 0.68 |
| CD4mem_nm16 | cg15700429 | HLA-DRB6 | NR_001298 | 0.79 | 0.88 | 0.89 | 0.88 | 0.85 |
| CD4mem_nm17 | cg25232888 | OSBPL5 | NM_001144063 | 0.79 | 0.74 | 0.90 | 0.92 | 0.92 |
| CD4mem_nm18 | cg05606115 | — | — | 0.86 | 0.89 | 0.91 | 0.92 | 0.92 |
| CD4mem_nm19 | cg15654485 | HLA-DRB6 | NR_001298 | 0.87 | 0.86 | 0.89 | 0.90 | 0.90 |
| CD4mem_nm20 | cg20601736 | ERICH1 | NM_207332 | 0.88 | 0.88 | 0.88 | 0.90 | 0.87 |
| CD4mem_nm21 | cg01419713 | PLAT | NM_000930 | 0.87 | 0.91 | 0.91 | 0.90 | 0.89 |
| CD4mem_nm22 | cg13213216 | KIAA1210 | NM_020721 | 0.95 | 0.95 | 0.97 | 0.97 | 0.96 |
| CD4mem_nm23 | cg23812489 | FLG2 | NM_001014342 | 0.92 | 0.91 | 0.92 | 0.90 | 0.91 |
| CD4mem_nm24 | cg08916385 | GNRHR | NM_000406 | 0.91 | 0.88 | 0.90 | 0.89 | 0.87 |
| CD4mem_nm25 | cg13011976 | PAGE2B | NM_001015038 | 0.87 | 0.89 | 0.87 | 0.89 | 0.88 |
| CD4mem_nm26 | cg09354553 | — | — | 0.94 | 0.95 | 0.93 | 0.94 | 0.92 |
| CD4mem_nm27 | cg00944599 | TRRAP | NM_003496 | 0.86 | 0.83 | 0.88 | 0.87 | 0.82 |
| CD4mem_nm28 | cg07904290 | — | — | 0.96 | 0.98 | 0.97 | 0.97 | 0.97 |
| CD4mem_nm29 | cg22626897 | SMYD3 | NM_001167740 | 0.91 | 0.91 | 0.91 | 0.90 | 0.91 |
| CD4mem_nm30 | cg18887230 | SMURF1 | NM_020429 | 0.89 | 0.89 | 0.89 | 0.89 | 0.87 |
| CD4mem_nm31 | cg16490805 | — | — | 0.79 | 0.63 | 0.71 | 0.73 | 0.71 |
| CD4mem_nm32 | cg18203203 | — | — | 0.71 | 0.73 | 0.74 | 0.70 | 0.71 |
| CD4mem_nm33 | cg22951524 | AHRR | NM_020731 | 0.82 | 0.83 | 0.84 | 0.84 | 0.84 |
| CD4mem_nm34 | cg07712165 | TBCD | NM_005993 | 0.90 | 0.90 | 0.91 | 0.91 | 0.91 |
| CD4mem_nm35 | cg01201914 | — | — | 0.82 | 0.82 | 0.83 | 0.82 | 0.82 |
| CD4mem_nm36 | cg07951602 | — | — | 0.82 | 0.85 | 0.82 | 0.84 | 0.83 |
| CD4mem_nm37 | cg21498326 | — | — | 0.86 | 0.89 | 0.87 | 0.89 | 0.83 |
| CD4mem_nm38 | cg11791078 | RANBP3L | NM_145000 | 0.82 | 0.70 | 0.74 | 0.75 | 0.76 |
| CD4mem_nm39 | cg15613905 | MCC | NM_002387 | 0.76 | 0.80 | 0.81 | 0.82 | 0.82 |
| CD4mem_nm40 | cg09307431 | — | — | 0.87 | 0.86 | 0.86 | 0.86 | 0.87 |
| CD4mem_nm41 | cg21911000 | CD28 | NM_006139 | 0.88 | 0.86 | 0.89 | 0.91 | 0.89 |
| CD4mem_nm42 | cg20770572 | HLA-DQB1 | NM_002123 | 0.87 | 0.87 | 0.88 | 0.87 | 0.86 |
| CD4mem_nm43 | cg22787186 | — | — | 0.62 | 0.65 | 0.84 | 0.80 | 0.81 |

TABLE 4E-continued

CD4 positive T cell Marker

| Marker-ID | CD4+ Th naive | CD4+ Th1 | CD4+ Th2 | CD4+ Th Central Mem. | CD4+ Th Effect. Mem. | CD8+ Cyto-toxic T-Cells | NK T-Cells | Discovery Fragment |
|---|---|---|---|---|---|---|---|---|
| nCD4-nm1 | 0.18 | 0.85 | 0.89 | 0.82 | 0.90 | 0.54 | 0.92 | CGGATAGATTAGTTCTGGAATAATGCCTGAGACACAGCACCCAGAACCTC (SEQ ID NO: 942) |
| nCD4_nm2 | 0.21 | 0.87 | 0.83 | 0.77 | 0.88 | 0.68 | 0.92 | TGTTGTGGGAAGCTTTCCCGTGCGCTGTAGGATGTTTAGCAGCACCCTCG (SEQ ID NO: 943) |
| nCD4_nm3 | 0.19 | 0.81 | 0.72 | 0.75 | 0.87 | 0.52 | 0.91 | GTACTCTTACACTCACGGGGGTGCCGGGCCCCTGGAACCTGCAACTCACG (SEQ ID NO: 944) |
| nCD4_nm4 | 0.16 | 0.74 | 0.57 | 0.59 | 0.75 | 0.57 | 0.89 | CGGAATTTTTTAGTGCAAAATATTTACTAGTGTGAGGCAGAACATTATTA (SEQ ID NO: 945) |
| nCD4_nm5 | 0.22 | 0.88 | 0.78 | 0.66 | 0.74 | 0.66 | 0.92 | CGAGTCTATGTAATTAAGAGACTGAGAATTACACTAGGGACCTCCTATAG (SEQ ID NO: 946) |
| nCD4_nm6 | 0.20 | 0.81 | 0.68 | 0.65 | 0.81 | 0.54 | 0.93 | GTAGCTAAGTAAGGGGCATTCATTTCTCCCTTTCTTGTTAAGGAACTACG (SEQ ID NO: 947) |
| nCD4_nm7 | 0.19 | 0.69 | 0.62 | 0.59 | 0.60 | 0.55 | 0.87 | CATACTTCAAACATAACGTGTCTTAAAACAACTTTTGATCTCTGTCACCG (SEQ ID NO: 948) |
| nCD_meth1 | 0.61 | 0.14 | 0.14 | 0.24 | 0.15 | 0.35 | 0.07 | CGCCCCCGCGGGGCCCAGCCAGATGTCAGCTGCAGTTATTAGCCTGGGCG (SEQ ID NO: 949) |
| nCD_meth1 | 0.69 | 0.16 | 0.35 | 0.34 | 0.29 | 0.43 | 0.05 | CGTGTCTTGATTCCACCTTTAGAGGCTGCCCAGGGTTTCACACCCGACCC (SEQ ID NO: 950) |
| nCD_meth1 | 0.63 | 0.07 | 0.19 | 0.25 | 0.16 | 0.42 | 0.05 | CGAGCCTGTGGCTTTCAAGCTGTGGACATCTGGCCTAGCTAGATTCTAC (SEQ ID NO: 951) |
| nCD_meth1 | 0.69 | 0.14 | 0.16 | 0.27 | 0.17 | 0.11 | 0.01 | CGCAACTGATCCGAGGACAGGCTCGGCCTCCCACACGCCCCCACCCCCCA (SEQ ID NO: 952) |
| nCD_meth1 | 0.74 | 0.24 | 0.23 | 0.32 | 0.25 | 0.17 | 0.04 | GTCTCCTTCATTCATTGGCCTCTGCTGGGGCCTCCTATGGGTGTCTTACG (SEQ ID NO: 953) |
| CD4mem_nm1 | 0.92 | 0.90 | 0.91 | 0.47 | 0.02 | 0.89 | 0.85 | CCATACCACTTGTGCATGCATGTGATGTTCTAATACCAATTGAAGAACCG (SEQ ID NO: 954) |
| CD4mem_nm2 | 0.93 | 0.87 | 0.87 | 0.44 | 0.03 | 0.91 | 0.83 | GGCAGTGTTGACTGCGTTCCATACCGGGACATCCAACACAACATTTGTCG (SEQ ID NO: 955) |

TABLE 4E-continued

CD4 positive T cell Marker

| | | | | | | | | |
|---|---|---|---|---|---|---|---|---|
| CD4mem_nm3 | 0.92 | 0.11 | 0.08 | 0.26 | 0.13 | 0.67 | 0.59 | CGGATGCCCTCGTGG GCCAGCTATCCCCAG GCACAGCGAGACAG CGACGT (SEQ ID NO: 956) |
| CD4mem_nm4 | 0.94 | 0.90 | 0.90 | 0.48 | 0.11 | 0.93 | 0.93 | CCACCGTGCCCAGCT CTTTTCTTTCTCTAAG AATCCTCTGGCATTC TGCG (SEQ ID NO: 957) |
| CD4mem_nm5 | 0.73 | 0.91 | 0.91 | 0.46 | 0.03 | 0.91 | 0.88 | CTCACTCCCATGCTG TTACAGGTCACCTCT TGCAGGGGCATATTT GATCG (SEQ ID NO: 958) |
| CD4mem_nm6 | 0.87 | 0.93 | 0.92 | 0.50 | 0.12 | 0.94 | 0.90 | AAATATTACCTATTA GATTGGTAACAATGA AAAAGACTTGGCAG CCGCCG (SEQ ID NO: 959) |
| CD4mem_nm7 | 0.88 | 0.85 | 0.85 | 0.44 | 0.06 | 0.86 | 0.80 | CGCCAACAGAGGAT GGCCAGCCCCACCCC AGAGGACAGCGCAC CCACGGC (SEQ ID NO: 960) |
| CD4mem_nm8 | 0.83 | 0.75 | 0.73 | 0.46 | 0.04 | 0.86 | 0.87 | CGTTATCAGTAGTTC TAAACAGCCATAGTA GTCACAGTGCCAGAA GTGAG (SEQ ID NO: 961) |
| CD4mem_nm9 | 0.97 | 0.97 | 0.98 | 0.55 | 0.31 | 0.97 | 0.98 | GCCGGGCGAGCTGA GATCAGACAACAGG CGCTGGACGCATCCT AACTACG (SEQ ID NO: 962) |
| CD4mem_nm10 | 0.88 | 0.75 | 0.75 | 0.46 | 0.06 | 0.84 | 0.76 | GGAAGTCAGAAAGC TGCTCACTCCATTCC ACTGTGAGAGGGCTT GTCACG (SEQ ID NO: 963) |
| CD4mem_nm11 | 0.69 | 0.18 | 0.09 | 0.27 | 0.15 | 0.70 | 0.57 | TGTGAGTTAGTTCTA CAGCACAATGCTTGG CTGCTGTTTCAGCAA TTGCG (SEQ ID NO: 964) |
| CD4mem_nm12 | 0.79 | 0.55 | 0.53 | 0.45 | 0.04 | 0.70 | 0.72 | CGACTTCCCAGCCAA GGGAAACTGTCACCG AGGGTGGGACTAAA TCTGAC (SEQ ID NO: 965) |
| CD4mem_nm13 | 0.73 | 0.56 | 0.57 | 0.20 | 0.17 | 0.76 | 0.71 | CGCGCGCCTATTGAT TTGTTTCTGAGGAGA GTACACCGTTCACTA TTGTA (SEQ ID NO: 966) |
| CD4mem_nm14 | 0.93 | 0.94 | 0.94 | 0.59 | 0.14 | 0.93 | 0.93 | TCTGCGTATTCCTTTC TGTTCTTTAAAAATG TTAAACCATGGGGTG CTCG (SEQ ID NO: 967) |
| CD4mem_nm15 | 0.83 | 0.82 | 0.81 | 0.48 | 0.03 | 0.82 | 0.69 | CGCCCCACACTGGGG TCACCCACCTATGAG CGGATCCAGGGGCA CTCTGC (SEQ ID NO: 968) |
| CD4mem_nm16 | 0.74 | 0.76 | 0.80 | 0.39 | 0.13 | 0.72 | 0.72 | TTCCTCAGCTCCTGT TCTTGGCCTGAAACC CCACAGCCTTGATGG CAGCG (SEQ ID NO: 969) |
| CD4mem_nm17 | 0.97 | 0.94 | 0.94 | 0.52 | 0.19 | 0.95 | 0.86 | CGTACAGAGCCTTAA ACCACATCGTGGCGG TGCCGTCTGAGCTGT AGCGG (SEQ ID NO: 970) |

TABLE 4E-continued

| CD4 positive T cell Marker | | | | | | | | |
|---|---|---|---|---|---|---|---|---|
| CD4mem_nm18 | 0.90 | 0.88 | 0.85 | 0.49 | 0.16 | 0.86 | 0.80 | CTTTTCCTTGCTAAA TCAATTCCCTAAGAC ATCAGGACTGTGAGA CATCG (SEQ ID NO: 971) |
| CD4mem_nm19 | 0.89 | 0.87 | 0.88 | 0.44 | 0.18 | 0.87 | 0.90 | CTCATATAACCCCAA GAGGTAAATTAGTAT AATTTAACCTACATT ATACG (SEQ ID NO: 972) |
| CD4mem_nm20 | 0.87 | 0.83 | 0.82 | 0.43 | 0.17 | 0.87 | 0.83 | CAGAAACCTCACACT CAATTAGCGAGACTG CAAACACTCTGTATT AACCG (SEQ ID NO: 973) |
| CD4mem_nm21 | 0.81 | 0.14 | 0.16 | 0.22 | 0.19 | 0.72 | 0.68 | CGCCTCCCACCCCTG GCAGGCTGCCATCTT TGCCAAGCACAGGA GGTCGC (SEQ ID NO: 974) |
| CD4mem_nm22 | 0.96 | 0.96 | 0.96 | 0.59 | 0.26 | 0.96 | 0.95 | ATCATTGTTCTCTCC GTGCAGCTAGGTATG CCGCAAGGTCTCGGG TTCCG (SEQ ID NO: 975) |
| CD4mem_nm23 | 0.92 | 0.91 | 0.91 | 0.51 | 0.19 | 0.92 | 0.90 | CATTTTCCCAAGGGT CCAGGCCCTAAACAT GCCAGACTACCAGTG GATCG (SEQ ID NO: 976) |
| CD4mem_nm24 | 0.92 | 0.53 | 0.51 | 0.18 | 0.27 | 0.88 | 0.83 | CGCATTTGAGGAGCT CTAAGTTGTTGAATC TAAGTTGTTGGATGA GTCAA (SEQ ID NO: 977) |
| CD4mem_nm25 | 0.83 | 0.37 | 0.30 | 0.25 | 0.19 | 0.77 | 0.69 | CGTTGTCAGGAGCGC TGGTGGTTTAGGTTC TCCACAGACGCAGG AAAACA (SEQ ID NO: 978) |
| CD4mem_nm26 | 0.91 | 0.90 | 0.93 | 0.61 | 0.20 | 0.93 | 0.70 | CGCCAACACAGACG AACCCCAACACGTGG CAAACCCCAACACA GGCGAAC (SEQ ID NO: 979) |
| CD4mem_nm27 | 0.72 | 0.15 | 0.20 | 0.24 | 0.16 | 0.81 | 0.66 | TCCTCAACATGGTAT GGGGTTCGCTATCAC CAGCGTGAAGATGG AAACG (SEQ ID NO: 980) |
| CD4mem_nm28 | 0.97 | 0.97 | 0.96 | 0.20 | 0.46 | 0.95 | 0.93 | CGATGACTAATTTGG TTAGCGGCAACAACA GGCTTCTTGCGGCGA GGCCT (SEQ ID NO: 981) |
| CD4mem_nm29 | 0.88 | 0.89 | 0.87 | 0.54 | 0.23 | 0.90 | 0.89 | CGGCGTGTGTCTTTG TTGAATGCCTTATTG AGGTCACACACTCTA TGCTT (SEQ ID NO: 982) |
| CD4mem_nm30 | 0.71 | 0.24 | 0.15 | 0.26 | 0.21 | 0.71 | 0.68 | CGGCCATCCTGCTTT AGGGATGAATTGAA ACTGGAAAGAGAGT AGTACCA (SEQ ID NO: 983) |
| CD4mem_nm31 | 0.83 | 0.70 | 0.69 | 0.28 | 0.05 | 0.86 | 0.83 | TGAGAAGGGGCACC CAATGTGCTTCCTCT TGGGGTGCAGCGGTG TGGCCG (SEQ ID NO: 984) |
| CD4mem_nm32 | 0.76 | 0.52 | 0.56 | 0.21 | 0.04 | 0.77 | 0.67 | CGCACACACATACTT GCATGTGGATGCAAA CACAATTGGTGCATG GGTTT (SEQ ID NO: 985) |

TABLE 4E-continued

CD4 positive T cell Marker

| | | | | | | | | |
|---|---|---|---|---|---|---|---|---|
| CD4mem_nm33 | 0.83 | 0.74 | 0.75 | 0.43 | 0.16 | 0.80 | 0.71 | CGCATCTGAGCGTAG ACACACAGATCTGAG CTTGGATGGTGGTCA CTGCG (SEQ ID NO: 986) |
| CD4mem_nm34 | 0.91 | 0.91 | 0.91 | 0.22 | 0.44 | 0.91 | 0.90 | CAGAAGGTCACACA GACGGTTGCGCTGCT CTCTCACCACTGCAA GCTCCG (SEQ ID NO: 987) |
| CD4mem_nm35 | 0.87 | 0.46 | 0.87 | 0.42 | 0.16 | 0.84 | 0.82 | CGCCTAGGCTCAAGC AATCTGGCTCTGGAT GTCTTTAACTTGTGA TTGAA (SEQ ID NO: 988) |
| CD4mem_nm36 | 0.88 | 0.78 | 0.79 | 0.20 | 0.17 | 0.80 | 0.70 | CGCCTCTCAAGAGCA CGATGTAAGGGCTCC AAGATGAGTTTGGGC TTCCC (SEQ ID NO: 989) |
| CD4mem_nm37 | 0.88 | 0.14 | 0.18 | 0.35 | 0.24 | 0.74 | 0.59 | CGGTTAAACATTGGT ATAGAAACCAGATCT ACTTTTAATTGAAAT CAGAC (SEQ ID NO: 990) |
| CD4mem_nm38 | 0.61 | 0.66 | 0.60 | 0.07 | 0.09 | 0.65 | 0.71 | CGGAAAAGGAGCTT GTCTTGAGAAACAAC AAAGAATTGAGCTAT AGTTTC (SEQ ID NO: 991) |
| CD4mem_nm39 | 0.84 | 0.44 | 0.44 | 0.10 | 0.33 | 0.74 | 0.61 | TGCAGTTAGGACTCC ATAGCAGGCCTGCAG TGGCCCTGGTGATAA CCTCG (SEQ ID NO: 992) |
| CD4mem_nm40 | 0.81 | 0.19 | 0.24 | 0.33 | 0.26 | 0.66 | 0.53 | AGGAAGCCTTTAAAG GACTGGACCCGGAA AGCACCTACTAAAGT GTATCG (SEQ ID NO: 993) |
| CD4mem_nm41 | 0.85 | 0.38 | 0.32 | 0.41 | 0.25 | 0.82 | 0.78 | CGGTTAATTATGGAA AAACAGCTTGTTAAG CAAATGCTAATGTAA GAAGA (SEQ ID NO: 994) |
| CD4mem_nm42 | 0.88 | 0.83 | 0.83 | 0.27 | 0.42 | 0.83 | 0.79 | CGGTGACAGATTTCT ATCCAGGCCAGATCA AAGTCCGGTGGTTTC GGAAT (SEQ ID NO: 995) |
| CD4mem_nm43 | 0.84 | 0.85 | 0.83 | 0.27 | 0.25 | 0.80 | 0.82 | CGGTACCTCTACTGC TGAGTCCAAAGTCAC CGCGGCATACCCAGC TCGGC (SEQ ID NO: 996) |

TABLE 4F

Monocytes-Markers

| Marker-ID | TargetID | SYMBOL | Accession | Basophil Granulocytes | Eosinphil Granulocytes | Neutrophil Granulocytes | Classical Monocytes | Non-classical Monocytes | NK classical |
|---|---|---|---|---|---|---|---|---|---|
| MOC_nm21 | cg23244761 | PARK2 | NM_004562 | 0.96 | 0.96 | 0.97 | 0.03 | 0.06 | 0.97 |
| MOC_nm22 | cg13430807 | MTMR11 | NM_181873 | 0.84 | 0.84 | 0.86 | 0.03 | 0.07 | 0.89 |
| MOC_nm23 | cg05923857 | TCF7L2 | NM_001146284 | 0.79 | 0.82 | 0.81 | 0.02 | 0.08 | 0.92 |
| MOC_nm24 | cg01041239 | LDLRAD4 (C18orf1) | NM_181482 | 0.76 | 0.85 | 0.77 | 0.03 | 0.08 | 0.93 |
| MOC_nm25 | cg21459713 | ERICH1 | NM_207332 | 0.90 | 0.92 | 0.94 | 0.08 | 0.14 | 0.91 |
| MOC_nm26 | cg12655112 | EHD4 | NM_139265 | 0.96 | 0.82 | 0.68 | 0.01 | 0.04 | 0.97 |
| MOC_nm27 | cg10480329 | CENPA | NM_001809 | 0.91 | 0.86 | 0.84 | 0.07 | 0.09 | 0.94 |
| MOC_nm28 | cg14428166 | MYOF | NM_133337 | 0.94 | 0.92 | 0.85 | 0.11 | 0.11 | 0.95 |

TABLE 4F-continued

Monocytes-Markers

| | | | | | | | | | |
|---|---|---|---|---|---|---|---|---|---|
| MOC_nm29 | cg25898577 | PPM1F | NM_014634 | 0.89 | 0.85 | 0.73 | 0.06 | 0.07 | 0.84 |
| MOC_nm30 | cg16636767 | FAR1 | NM_032228 | 0.91 | 0.92 | 0.91 | 0.10 | 0.15 | 0.92 |
| MOC_nm31 | cg02244028 | SCN11A | NM_014139 | 0.89 | 0.90 | 0.86 | 0.13 | 0.12 | 0.88 |
| MOC_nm32 | cg07213487 | TRRAP | NM_003496 | 0.90 | 0.91 | 0.91 | 0.10 | 0.13 | 0.90 |
| MOC_nm33 | cg03963853 | MGRN1 | NM_015246 | 0.98 | 0.97 | 0.97 | 0.26 | 0.27 | 0.97 |
| MOC_nm34 | cg22056336 | RBM47 | NM_019027 | 0.90 | 0.89 | 0.87 | 0.18 | 0.16 | 0.85 |
| MOC_nm35 | cg18066690 | KIAA0146 | NM_001080394 | 0.92 | 0.91 | 0.91 | 0.06 | 0.10 | 0.91 |
| MOC_nm36 | cg00101629 | KAZN (KIAA1-26) | NM_201628 | 0.90 | 0.89 | 0.84 | 0.11 | 0.14 | 0.88 |
| MOC_nm37 | cg20918393 | RIN2 | — | 0.97 | 0.97 | 0.90 | 0.21 | 0.12 | 0.98 |
| MOC_nm38 | cg10732094 | ERCC1 | — | 0.86 | 0.81 | 0.76 | 0.13 | 0.09 | 0.87 |
| ncMOC_nm1 | cg04143805 | ANKRD11 | NM_013275 | 0.88 | 0.88 | 0.89 | 0.82 | 0.32 | 0.91 |
| ncMOC_nm3 | cg07004744 | ERICH1 | NM_207332 | 0.95 | 0.94 | 0.93 | 0.93 | 0.39 | 0.96 |
| ncMOC_nm6 | cg07369606 | SECTM1 | NM_003004 | 0.89 | 0.89 | 0.93 | 0.91 | 0.48 | 0.95 |
| ncMOC_nm8 | cg02029908 | DUSP1 | NM_004417 | 0.93 | 0.94 | 0.94 | 0.92 | 0.23 | 0.93 |
| ncMOC_nm9 | cg16908740 | — | — | 0.91 | 0.86 | 0.90 | 0.85 | 0.18 | 0.93 |
| ncMOC_nm10 | cg08969823 | — | — | 0.96 | 0.94 | 0.94 | 0.96 | 0.30 | 0.95 |
| ncMOC_nm11 | cg14684854 | — | — | 0.91 | 0.90 | 0.91 | 0.91 | 0.26 | 0.88 |
| ncMOC_nm12 | cg24534048 | — | — | 0.98 | 0.97 | 0.96 | 0.82 | 0.18 | 0.98 |
| ncMOC_nm13 | cg19683800 | CYB561 | NM_001017917 | 0.90 | 0.76 | 0.85 | 0.87 | 0.24 | 0.93 |
| ncMOC_nm15 | cg08376310 | KCNQ1 | NM_000218 | 0.88 | 0.79 | 0.91 | 0.81 | 0.19 | 0.98 |
| ncMOC_nm19 | cg07457429 | — | — | 0.91 | 0.91 | 0.92 | 0.87 | 0.29 | 0.92 |
| ncMOC_nm20 | cg10492417 | FANCA | NM_000135 | 0.86 | 0.89 | 0.90 | 0.83 | 0.25 | 0.88 |
| ncMOC_nm21 | cg01742428 | FAM26F | NM_001010919 | 0.91 | 0.92 | 0.92 | 0.91 | 0.36 | 0.92 |
| ncMOC_nm22 | cg19586199 | PRKACA | NM_207518 | 0.91 | 0.93 | 0.97 | 0.96 | 0.45 | 0.98 |
| ncMOC_nm24 | cg10143416 | — | — | 0.93 | 0.95 | 0.94 | 0.95 | 0.46 | 0.95 |
| ncMOC_nm25 | cg03263792 | TSPAN16 | NM_012466 | 0.87 | 0.77 | 0.79 | 0.85 | 0.37 | 0.86 |
| ncMOC_nm26 | cg09779405 | — | — | 0.86 | 0.83 | 0.81 | 0.73 | 0.25 | 0.85 |
| ncMOC_nm27 | cg16288101 | — | — | 0.90 | 0.85 | 0.85 | 0.74 | 0.26 | 0.88 |
| ncMOC_nm28 | cg20380448 | NAAA | NM_001042402 | 0.80 | 0.81 | 0.77 | 0.83 | 0.35 | 0.83 |
| ncMOC_nm29 | cg05390144 | ELF5 | NM_001422 | 0.87 | 0.88 | 0.88 | 0.87 | 0.42 | 0.88 |
| ncMOC_nm30 | cg13187188 | GPR152 | NM_206997 | 0.88 | 0.88 | 0.88 | 0.88 | 0.44 | 0.95 |
| ncMOC_nm31 | cg04322596 | TCF7L2 | NM_001146284 | 0.93 | 0.90 | 0.90 | 0.92 | 0.49 | 0.92 |
| ncMOC_nm32 | cg07744832 | UHRF1BP1L | NM_001006947 | 0.87 | 0.88 | 0.89 | 0.89 | 0.48 | 0.86 |
| ncMOC_nm33 | cg13318914 | DDAH2 | NM_013974 | 0.87 | 0.80 | 0.84 | 0.80 | 0.39 | 0.89 |
| ncMOC_nm34 | cg14439774 | SMG6 | NM_017575 | 0.87 | 0.83 | 0.86 | 0.87 | 0.46 | 0.81 |
| ncMOC_nm35 | cg15896579 | — | — | 0.80 | 0.72 | 0.75 | 0.76 | 0.36 | 0.76 |
| ncMOC_nm36 | cg09736194 | LOC285740 | NR_027113 | 0.88 | 0.75 | 0.85 | 0.87 | 0.49 | 0.91 |
| ncMOC_nm37 | cg18898336 | RGS12 | NM_198229 | 0.89 | 0.88 | 0.89 | 0.85 | 0.46 | 0.88 |
| ncMOC_nm38 | cg09262230 | TMEM181 | NM_020823 | 0.94 | 0.95 | 0.96 | 0.95 | 0.57 | 0.95 |
| ncMOC_nm39 | cg10794991 | — | — | 0.97 | 0.95 | 0.97 | 0.84 | 0.46 | 0.96 |
| ncMOC_nm40 | cg02667577 | WIPI2 | NM_016003 | 0.85 | 0.84 | 0.88 | 0.85 | 0.28 | 0.58 |
| ncMOC_nm42 | cg06070445 | BCL6 | NM_001706 | 0.88 | 0.69 | 0.69 | 0.70 | 0.18 | 0.86 |
| ncMOC_nm44 | cg24143729 | RASA3 | NM_007368 | 0.86 | 0.85 | 0.84 | 0.67 | 0.25 | 0.86 |
| ncMOC_nm46 | cg11129609 | WDR46 | NM_005452 | 0.79 | 0.60 | 0.52 | 0.58 | 0.13 | 0.67 |
| ncMOC_nm48 | cg02317313 | LOC338799 | NR_002809 | 0.80 | 0.57 | 0.77 | 0.61 | 0.21 | 0.89 |
| ncMOC_nm50 | cg04690793 | SNRPC | NR_029472 | 0.89 | 0.40 | 0.77 | 0.75 | 0.11 | 0.85 |

| Marker-ID | B-Cells | CD4+ Th naive | CD4+ Th1 | CD4+ Th2 | CD4+ Th Central Mem. | CD4+ Th Effect. Mem. | CD8+ Cyto-toxic T-Cells | NK T-Cells | Discovery Fragment |
|---|---|---|---|---|---|---|---|---|---|
| MOC_nm21 | 0.98 | 0.98 | 0.98 | 0.99 | 0.99 | 0.98 | 0.97 | 0.98 | TGGGATGGAACGGCTGC GACAGATCTCCATTAAA GCCAGCGCGTCGTTCG (SEQ ID NO: 997) |
| MOC_nm22 | 0.82 | 0.86 | 0.87 | 0.90 | 0.89 | 0.89 | 0.90 | 0.86 | TTCTTGGACCCCTCTTCT TTGTCCCTTCTTCCTCTT TATCACCCAGAGCG (SEQ ID NO: 998) |
| MOC_nm23 | 0.92 | 0.80 | 0.83 | 0.84 | 0.80 | 0.84 | 0.90 | 0.90 | CGGCCATCAACCAGATC CTTGGGCGGAGGGTAGG TGACGCCCTTCTCAGG (SEQ ID NO: 999) |
| MOC_nm24 | 0.83 | 0.75 | 0.94 | 0.95 | 0.89 | 0.95 | 0.75 | 0.89 | CGCCGCTCATGGGCCTG GTGTGCATGCAGCTGCG CAGAGGGCCTCTGCCT (SEQ ID NO: 1000) |
| MOC_nm25 | 0.93 | 0.92 | 0.84 | 0.90 | 0.89 | 0.91 | 0.92 | 0.89 | TTGTGAGGAGGATGGTG TGGACACCAGCGAGGAA GACCCGACACTGGCCG (SEQ ID NO: 1001) |
| MOC_nm26 | 0.88 | 0.95 | 0.90 | 0.80 | 0.87 | 0.80 | 0.97 | 0.96 | AGAGAAACTCCACGCCC ACTAACAGTCATTCTCTA TTTCGTTTGCATGCG (SEQ ID NO: 1002) |

TABLE 4F-continued

| Monocytes-Markers | | | | | | | | | |
|---|---|---|---|---|---|---|---|---|---|
| MOC_nm27 | 0.91 | 0.93 | 0.93 | 0.94 | 0.93 | 0.93 | 0.93 | 0.92 | CGATCTTAAGAGAAAGG GCAGGAGTGTTTCCTTG ACCCCACATTCTCACT (SEQ ID NO: 1003) |
| MOC_nm28 | 0.95 | 0.95 | 0.93 | 0.95 | 0.95 | 0.95 | 0.96 | 0.95 | CGCCCCCGGGGTAGCGG CTCTCGTTCTGATAGACT TCATCAGTGAACTCC (SEQ ID NO: 1004) |
| MOC_nm29 | 0.91 | 0.89 | 0.88 | 0.88 | 0.87 | 0.88 | 0.92 | 0.89 | CGCTGATCCAGTCACCG GGGAGGGGCTGACTGGC AGCCACACAGAGGTTT (SEQ ID NO: 1005) |
| MOC_nm30 | 0.88 | 0.90 | 0.92 | 0.92 | 0.92 | 0.92 | 0.90 | 0.90 | CGGTTCCCAATTTGAAG AGTGGAGACAGAAGTCA AGAAAATAAGCTTTTC SEQ ID NO: 1006) |
| MOC_nm31 | 0.91 | 0.91 | 0.89 | 0.88 | 0.89 | 0.90 | 0.91 | 0.88 | CGGCTCAGCCTTATTGTC TTGCTTAATGTCTGGGTC TCAGTTTTAGAGAC (SEQ ID NO: 1007) |
| MOC_nm32 | 0.60 | 0.92 | 0.90 | 0.89 | 0.90 | 0.90 | 0.92 | 0.92 | TGTGAAGCAGCTAGAGG CGCGCTGGAAACCTGAT GCATGCTGCTGCCTCG (SEQ ID NO: 1008) |
| MOC_nm33 | 0.98 | 0.98 | 0.99 | 0.98 | 0.98 | 0.98 | 0.97 | 0.98 | TGGCCACGGGTCATTCG TGGTTCCCCTGGAGCCTT GCGGTGTATAGAGCG (SEQ ID NO: 1009) |
| MOC_nm34 | 0.75 | 0.88 | 0.81 | 0.83 | 0.84 | 0.83 | 0.87 | 0.82 | CGTGAACTTCCTAGAGG CCAAAGTAAAAATAAAA ACAGGGTCGCTAACAT (SEQ ID NO: 1010) |
| MOC_nm35 | 0.91 | 0.93 | 0.91 | 0.92 | 0.94 | 0.91 | 0.92 | 0.91 | CGGAAGGTGAGTGGGCA ATGAAATGTCCAATTTT AAAAGAAATTCCACGT (SEQ ID NO: 1011) |
| MOC_nm36 | 0.75 | 0.92 | 0.83 | 0.86 | 0.85 | 0.85 | 0.86 | 0.69 | CGCAAGAATGCACTTAG TTAATCCAACAAGTATTT ATTCAGTGCCTGAGT (SEQ ID NO: 1012) |
| MOC_nm37 | 0.98 | 0.98 | 0.98 | 0.98 | 0.98 | 0.98 | 0.98 | 0.98 | TTTCAACAACACCACTG AAAGAATGTAAACGGAG CTGGTCGCGTTGGTCG (SEQ ID NO: 1013) |
| MOC_nm38 | 0.71 | 0.87 | 0.88 | 0.88 | 0.89 | 0.90 | 0.90 | 0.87 | GAGGAAGTCCTTTCTGG AGTCTGACCCTCAGTCT GCCTGCTTCAAATGCG (SEQ ID NO: 1014) |
| ncMOC_nm1 | 0.88 | 0.90 | 0.88 | 0.88 | 0.89 | 0.88 | 0.89 | 0.87 | CGAAATCAGCGGAGGCC CCTGCTGAGTGAGTGGA CACACCCAGGCGCACG (SEQ ID NO: 1015) |
| ncMOC_nm3 | 0.95 | 0.94 | 0.96 | 0.96 | 0.95 | 0.97 | 0.96 | 0.95 | AACATGAGCAGCATGGA CAACGCGGTACAACGGG GCGAGAGCGCCAACCG (SEQ ID NO: 1016) |
| ncMOC_nm6 | 0.95 | 0.89 | 0.88 | 0.89 | 0.90 | 0.90 | 0.93 | 0.88 | CGCAGGCTTGGAGCCAT GCCAGTGACACGCCTAG GAAAGTTCACGCACCG (SEQ ID NO: 1017) |
| ncMOC_nm8 | 0.93 | 0.93 | 0.92 | 0.91 | 0.89 | 0.89 | 0.94 | 0.88 | CCCACTATATATTGGTCC CGAATGTGCTGAGTTCA GCAAATGTCTTGACG (SEQ ID NO: 1018) |
| ncMOC_nm9 | 0.92 | 0.91 | 0.88 | 0.90 | 0.90 | 0.90 | 0.91 | 0.89 | CGGAAGAACACTTGTAT ATGCTGACATCAGCAAG CAAAATGCATACAGTT (SEQ ID NO: 1019) |
| ncMOC_nm10 | 0.97 | 0.96 | 0.96 | 0.95 | 0.97 | 0.96 | 0.96 | 0.95 | GGCTTCCGGTGACCAGG ATAGGAAGTGTTGCAGG CCCTGCCCCGAGGGCG (SEQ ID NO: 1020) |
| ncMOC_nm11 | 0.88 | 0.91 | 0.84 | 0.84 | 0.86 | 0.85 | 0.89 | 0.84 | CGCCGAGCTCAGCAGAA ACCCGCCCAGAAGGTCA AGGACCAGCAAAAGGG (SEQ ID NO: 1021) |

TABLE 4F-continued

Monocytes-Markers

| | | | | | | | | | |
|---|---|---|---|---|---|---|---|---|---|
| ncMOC_nm12 | 0.97 | 0.98 | 0.97 | 0.97 | 0.97 | 0.98 | 0.98 | 0.98 | GAGGCCTGGCACGGCGG CACCGGAAGCGGGTACT GGTGCCCTAAGGAGCG (SEQ ID NO: 1022) |
| ncMOC_nm13 | 0.92 | 0.86 | 0.91 | 0.92 | 0.94 | 0.93 | 0.94 | 0.94 | TGCGGGCCTCTCCTGCCC TTTGTACTCCACGAGGT GTGAGGAAGTTGCCG (SEQ ID NO: 1023) |
| ncMOC_nm15 | 0.94 | 0.84 | 0.98 | 0.97 | 0.98 | 0.98 | 0.98 | 0.97 | CGCGCTCACAGCCTCCG TTCCCAGACACGCCCGG GCCTGAGCCCCCAGGC (SEQ ID NO: 1024) |
| ncMOC_nm19 | 0.92 | 0.92 | 0.92 | 0.91 | 0.91 | 0.90 | 0.93 | 0.90 | CGGTCATAGTCCTCTGG AGTTGACATCAGTGGGA CCTCGGTGAAACTGCA (SEQ ID NO: 1025) |
| ncMOC_nm20 | 0.90 | 0.89 | 0.75 | 0.73 | 0.78 | 0.77 | 0.87 | 0.86 | CGCTGTCCGGAACTGGG GTGCTCCACCCACACTG TCTGGAACTGGCACAG (SEQ ID NO: 1026) |
| ncMOC_nm21 | 0.93 | 0.92 | 0.92 | 0.91 | 0.93 | 0.93 | 0.92 | 0.94 | CGCCCATCATAGAAGTA CCAGAACTTGAGCTGGA CTTTGCTGATTTAGCT (SEQ ID NO: 1027) |
| ncMOC_nm22 | 0.98 | 0.91 | 0.97 | 0.95 | 0.97 | 0.98 | 0.97 | 0.97 | CGCGGTTGCGCTAAGGG GAGAGCTGCCTTGATAA GACCTCTTGGGCACCC (SEQ ID NO: 1028) |
| ncMOC_nm24 | 0.93 | 0.93 | 0.91 | 0.92 | 0.92 | 0.92 | 0.91 | 0.85 | TGGGGAAGTCGCTGCTG AGAACTCCGATGCCAAG CGCTGACCCAGCCTCG (SEQ ID NO: 1029) |
| ncMOC_nm25 | 0.85 | 0.88 | 0.82 | 0.84 | 0.86 | 0.86 | 0.87 | 0.76 | TGAATGGATCCAGAGGC TCTGTGATGCAGAAATC TAGCTACAAGCCACCG (SEQ ID NO: 1030) |
| ncMOC_nm26 | 0.91 | 0.89 | 0.89 | 0.91 | 0.93 | 0.91 | 0.91 | 0.86 | CGTAATGATCTTGAGGA AGAAAGAAAATGCAAA GGGAAGTATGAAATAGC (SEQ ID NO: 1031) |
| ncMOC_nm27 | 0.86 | 0.89 | 0.89 | 0.89 | 0.89 | 0.90 | 0.90 | 0.89 | CGGTCTAATTAAAATAG GGAACAAGAACCAAAA AATCCCCTAGTTCCAGG (SEQ ID NO: 1032) |
| ncMOC_nm28 | 0.83 | 0.84 | 0.80 | 0.81 | 0.82 | 0.83 | 0.84 | 0.79 | CGGTGGAGTTCGGAGCA ATTTTTTGCAGGCAGGA AGTGGATCTTACAAAG (SEQ ID NO: 1033) |
| ncMOC_nm29 | 0.85 | 0.87 | 0.75 | 0.81 | 0.81 | 0.81 | 0.83 | 0.72 | CGGGCCAAATCATCACT GGGCAGAACTAGGCCAT AGGGTGCAAAATATAG (SEQ ID NO: 1034) |
| ncMOC_nm30 | 0.92 | 0.85 | 0.85 | 0.86 | 0.89 | 0.87 | 0.87 | 0.73 | CGCCCCATAGGAAGTAG TAGAAGCGGCAGGCAGC TGTCCCCAGCGGCCAG (SEQ ID NO: 1035) |
| ncMOC_nm31 | 0.91 | 0.92 | 0.91 | 0.92 | 0.93 | 0.93 | 0.91 | 0.87 | GGCCATAGTCACACCAA CAGTCAAACAGGAATCG TCCCAGAGTGATGTCG (SEQ ID NO: 1036) |
| ncMOC_nm32 | 0.89 | 0.87 | 0.87 | 0.87 | 0.86 | 0.89 | 0.87 | 0.80 | CGGCCTCCTTAGAATGTT TTAAGAATCGGCCATTA ACTCCTGTGCTTGCT (SEQ ID NO: 1037) |
| ncMOC_nm33 | 0.90 | 0.86 | 0.86 | 0.86 | 0.86 | 0.87 | 0.91 | 0.85 | CTCAGCTGTGGGGGCGT GTGCTGAGCACCAAGCA GAGGGAGCTGAGCCCG (SEQ ID NO: 1038) |
| ncMOC_nm34 | 0.89 | 0.87 | 0.87 | 0.89 | 0.87 | 0.87 | 0.89 | 0.85 | GCCAAATGACTGTGTTG GCCTATGGGTGACCTGG CCCCTGGCTAGAATCG (SEQ ID NO: 1039) |
| ncMOC_nm35 | 0.81 | 0.80 | 0.79 | 0.80 | 0.78 | 0.81 | 0.82 | 0.73 | CTGGATGGCAGACAGTG CGTGCAAGCATCACAGC CCACTGGAAGAGGCCG (SEQ ID NO: 1040) |

TABLE 4F-continued

Monocytes-Markers

| | | | | | | | | | |
|---|---|---|---|---|---|---|---|---|---|
| ncMOC_nm36 | 0.90 | 0.90 | 0.90 | 0.89 | 0.89 | 0.91 | 0.90 | 0.86 | TTCTTCAAAACCCTAGTC AGATATTGTTACTTCACT GAAAACTCTCACCG (SEQ ID NO: 1041) |
| ncMOC_nm37 | 0.88 | 0.88 | 0.81 | 0.84 | 0.84 | 0.83 | 0.83 | 0.76 | TGGCTGATGTCTGCTGA ACACCCGATCATTCACT CAACAGACAGCTCTCG (SEQ ID NO: 1042) |
| ncMOC_nm38 | 0.89 | 0.93 | 0.95 | 0.95 | 0.96 | 0.96 | 0.96 | 0.95 | AGGTCAGCAGACGGTCA CCGGGGAAAGCATCCAG GCATCTTGTCGCCTCG (SEQ ID NO: 1043) |
| ncMOC_nm39 | 0.95 | 0.97 | 0.97 | 0.97 | 0.97 | 0.96 | 0.98 | 0.97 | CGAGGAGTTGCACTCTA GCTGCCGTGCCAGCAGT CTCGTCTGCTGTGAACG (SEQ ID NO: 1044) |
| ncMOC_nm40 | 0.66 | 0.89 | 0.84 | 0.84 | 0.82 | 0.84 | 0.74 | 0.78 | CGGACTGACTGAACTTG ACCTGTGACCTCTGACC CGGGGAGCAGAGAACA (SEQ ID NO: 1045) |
| ncMOC_nm42 | 0.89 | 0.86 | 0.86 | 0.83 | 0.86 | 0.87 | 0.89 | 0.88 | CGTGCTGTAGAACATGC AAGACAGCACCCTGATG TGGGTGAATCTCATTT (SEQ ID NO: 1046) |
| ncMOC_nm44 | 0.63 | 0.85 | 0.83 | 0.84 | 0.85 | 0.84 | 0.81 | 0.83 | GGTCGTGACCCTGCCTC CACCCTGTGTAAAGTCA CAGCTGCAGGATCTCG (SEQ ID NO: 1047) |
| ncMOC_nm46 | 0.82 | 0.80 | 0.78 | 0.77 | 0.79 | 0.77 | 0.83 | 0.77 | CTGACAAGGGCAGAGGC ACAAGCAGGAGGGTGCA GCCTGTGGAAGGCCCG (SEQ ID NO: 1048) |
| ncMOC_nm48 | 0.86 | 0.78 | 0.87 | 0.86 | 0.87 | 0.86 | 0.83 | 0.87 | GGGGATGCCGGCGACTC AGTAGTAAGGCAAGTCC TGCCACCTCCTGGCCG (SEQ ID NO: 1049) |
| ncMOC_nm50 | 0.87 | 0.90 | 0.91 | 0.93 | 0.93 | 0.92 | 0.91 | 0.91 | CGGGGCACAGTTAACTT ACCCCTTAGGACCAGGA AGTAATCTTTGTGGTA (SEQ ID NO: 1050) |

TABLE 4G

Granolucytes and Subtypes Marker

| Marker-ID | TargetID | SYMBOL | Accession | Basophil Granulocytes | Eosinophil Granulocytes | Neutrophil Granulocytes | Classical Monocytes | Non-classical Monocytes | NK classical |
|---|---|---|---|---|---|---|---|---|---|
| GRC_nm38 | cg15010903 | TIMP2 | NM_003255 | 0.22 | 0.09 | 0.10 | 0.85 | 0.87 | 0.89 |
| GRC_nm39 | cg11014468 | DCP1A | NM_018403 | 0.06 | 0.09 | 0.09 | 0.93 | 0.91 | 0.91 |
| GRC_nm40 | cg07468327 | — | — | 0.09 | 0.07 | 0.12 | 0.76 | 0.82 | 0.87 |
| GRC_nm41 | cg21285555 | PCMTD1 | NM_052937 | 0.18 | 0.08 | 0.05 | 0.78 | 0.80 | 0.78 |
| GRC_nm42 | cg08110693 | PXT1 | NM_152990 | 0.06 | 0.01 | 0.20 | 0.72 | 0.77 | 0.88 |
| GRC_nm43 | cg13595556 | — | — | 0.11 | 0.06 | 0.04 | 0.68 | 0.77 | 0.87 |
| GRC_nm44 | cg03423077 | LOC339524 | NR_026986 | 0.01 | 0.07 | 0.15 | 0.67 | 0.74 | 0.90 |
| GRC_nm45 | cg00121045 | UNKL | NM_023076 | 0.14 | 0.13 | 0.11 | 0.67 | 0.74 | 0.81 |
| GRC_nm46 | cg07305933 | PVT1 | NR_003367 | 0.05 | 0.05 | 0.04 | 0.56 | 0.63 | 0.77 |
| GRC_nm47 | cg23661721 | — | — | 0.09 | 0.08 | 0.06 | 0.53 | 0.65 | 0.90 |
| GRC_nm48 | cg06168950 | — | — | 0.10 | 0.11 | 0.12 | 0.61 | 0.64 | 0.83 |
| GRC_nm49 | cg08435683 | SLC23A2 | NM_005116 | 0.02 | 0.11 | 0.49 | 0.95 | 0.94 | 0.95 |
| GRC_nm50 | cg00335124 | PDE4D | NM_001165899 | 0.12 | 0.05 | 0.05 | 0.76 | 0.84 | 0.34 |
| GRC_nm51 | cg06526020 | NUDT3 | NM_006703 | 0.31 | 0.06 | 0.05 | 0.80 | 0.83 | 0.90 |
| GRC_nm52 | cg03820688 | MTIF2 | NM_002453 | 0.08 | 0.27 | 0.16 | 0.80 | 0.82 | 0.90 |
| GRC_nm53 | cg15034267 | GTPBP1 | NM_004286 | 0.14 | 0.11 | 0.33 | 0.84 | 0.84 | 0.85 |
| GRC_nm54 | cg01400750 | ANAPC10 | NM_014885 | 0.37 | 0.06 | 0.03 | 0.78 | 0.81 | 0.87 |
| GRC_nm55 | cg24419094 | RRM2 | NM_001034 | 0.16 | 0.09 | 0.25 | 0.79 | 0.80 | 0.87 |
| GRC_nm56 | cg11313468 | HNRNPUL1 | NM_007040 | 0.31 | 0.11 | 0.06 | 0.74 | 0.84 | 0.89 |
| GRC_nm57 | cg00705730 | NCK2 | NM_003581 | 0.67 | 0.07 | 0.04 | 0.87 | 0.89 | 0.89 |
| GRC_nm58 | cg15609237 | TTN | NM_133378 | 0.48 | 0.09 | 0.16 | 0.79 | 0.87 | 0.95 |
| GRC_nm59 | cg19513582 | UBE2H | NM_003344 | 0.65 | 0.08 | 0.13 | 0.90 | 0.89 | 0.81 |
| GRC_nm60 | cg10687936 | ZNF148 | NM_021964 | 0.05 | 0.12 | 0.58 | 0.84 | 0.86 | 0.90 |
| GRC_nm61 | cg18168663 | REC8 | NM_001048205 | 0.06 | 0.10 | 0.26 | 0.73 | 0.74 | 0.71 |

TABLE 4G-continued

Granulocytes and Subtypes Marker

| | | | | | | | | | |
|---|---|---|---|---|---|---|---|---|---|
| GRC_nm62 | cg26814100 | MAP7 | NM_003980 | 0.13 | 0.12 | 0.28 | 0.73 | 0.82 | 0.92 |
| GRC_nm63 | cg10692528 | NCAPD2 | NM_014865 | 0.08 | 0.16 | 0.61 | 0.86 | 0.89 | 0.87 |
| GRC_nm64 | cg05120113 | GLB1 | NM_001135602 | 0.12 | 0.17 | 0.45 | 0.81 | 0.83 | 0.89 |
| GRC_nm65 | cg01799818 | VPS53 | NM_018289 | 0.31 | 0.12 | 0.42 | 0.86 | 0.85 | 0.89 |
| GRC_nm66 | cg02722672 | GRK4 | NM_001004057 | 0.55 | 0.06 | 0.25 | 0.82 | 0.90 | 0.93 |
| GRC_nm67 | cg06997767 | TRPS1 | NM_014112 | 0.03 | 0.11 | 0.21 | 0.64 | 0.73 | 0.43 |
| GRC_nm68 | cg05575639 | CHD7 | NM_017780 | 0.38 | 0.09 | 0.17 | 0.78 | 0.78 | 0.86 |
| GRC_nm69 | cg18502618 | COL18A1 | NM_130444 | 0.62 | 0.11 | 0.21 | 0.88 | 0.85 | 0.90 |
| GRC_nm70 | cg05684528 | — | — | 0.07 | 0.08 | 0.16 | 0.63 | 0.71 | 0.77 |
| GRC_nm71 | cg11958668 | RNF103 | NM_005667 | 0.27 | 0.14 | 0.65 | 0.89 | 0.91 | 0.81 |
| GRC_nm72 | cg14543285 | RCOR1 | NM_015156 | 0.63 | 0.11 | 0.10 | 0.82 | 0.83 | 0.86 |
| GRC_nm73 | cg20836212 | VKORC1L1 | NM_173517 | 0.06 | 0.18 | 0.64 | 0.82 | 0.86 | 0.89 |
| GRC_nm74 | cg25643253 | VKORC1L1 | NM_173517 | 0.07 | 0.18 | 0.65 | 0.82 | 0.82 | 0.86 |
| GRC_nm75 | cg19282952 | — | — | 0.10 | 0.17 | 0.54 | 0.82 | 0.80 | 0.88 |
| GRC_nm76 | cg24559796 | — | — | 0.06 | 0.16 | 0.55 | 0.76 | 0.81 | 0.87 |
| GRC_nm77 | cg08864944 | PBX1 | NM_002585 | 0.05 | 0.06 | 0.05 | 0.63 | 0.51 | 0.14 |
| GRC_nm78 | cg13416889 | ZNF609 | NM_015042 | 0.17 | 0.20 | 0.67 | 0.86 | 0.88 | 0.84 |
| GRC_nm79 | cg21762728 | C6orf70 | NM_018341 | 0.44 | 0.13 | 0.14 | 0.73 | 0.80 | 0.93 |
| GRC_nm80 | cg11596902 | — | — | 0.16 | 0.05 | 0.05 | 0.59 | 0.61 | 0.88 |
| GRC_nm81 | cg11231701 | CDK5RAP1 | NM_016082 | 0.60 | 0.04 | 0.90 | 0.74 | 0.78 | 0.78 |
| GRC_nm82 | cg26647135 | PILRB | NM_175047 | 0.65 | 0.15 | 0.18 | 0.84 | 0.85 | 0.88 |
| GRC_nm83 | cg07268332 | AMPD3 | NM_001025389 | 0.57 | 0.08 | 0.14 | 0.74 | 0.78 | 0.86 |
| GRC_nm84 | cg19935471 | MATN2 | NM_030583 | 0.76 | 0.10 | 0.10 | 0.85 | 0.79 | 0.84 |
| GRC_nm85 | cg08505883 | — | — | 0.09 | 0.11 | 0.39 | 0.67 | 0.74 | 0.87 |
| bGRC_nm1 | cg02329886 | HDC | NM_002112 | 0.06 | 0.84 | 0.90 | 0.91 | 0.89 | 0.90 |
| bGRC_nm2 | cg26676468 | MCC | NM_002387 | 0.02 | 0.90 | 0.96 | 0.96 | 0.95 | 0.95 |
| bGRC_nm3 | cg01782059 | ERI3 | NM_024066 | 0.03 | 0.75 | 0.97 | 0.96 | 0.96 | 0.97 |
| bGRC_nm4 | cg12646067 | TTLL8 | NM_001080447 | 0.03 | 0.87 | 0.96 | 0.95 | 0.95 | 0.95 |
| bGRC_nm5 | cg05012676 | ZFPM1 | NM_153813 | 0.04 | 0.88 | 0.96 | 0.96 | 0.95 | 0.95 |
| bGRC_nm6 | cg17306637 | TFB1M; CLDN20 | NM_016020 | 0.05 | 0.87 | 0.89 | 0.88 | 0.90 | 0.90 |
| bGRC_nm7 | cg22197708 | MS4A2 | NM_001142303 | 0.05 | 0.81 | 0.91 | 0.90 | 0.89 | 0.88 |
| bGRC_nm8 | cg03520003 | DENND3 | NM_014957 | 0.09 | 0.81 | 0.90 | 0.92 | 0.91 | 0.90 |
| bGRC_nm9 | cg16643422 | DLC1 | NM_182643 | 0.06 | 0.59 | 0.86 | 0.86 | 0.86 | 0.87 |
| bGRC_nm10 | cg18281744 | MAS1L | NM_052967 | 0.08 | 0.82 | 0.89 | 0.90 | 0.90 | 0.57 |
| bGRC_nm11 | cg07862744 | MAD1L1 | NM_003550 | 0.16 | 0.92 | 0.93 | 0.91 | 0.92 | 0.93 |
| bGRC_nm12 | cg03555710 | PFKFB3 | NM_001145443 | 0.08 | 0.81 | 0.96 | 0.97 | 0.97 | 0.97 |
| bGRC_nm13 | cg24057792 | — | — | 0.05 | 0.69 | 0.93 | 0.94 | 0.91 | 0.93 |
| bGRC_nm14 | cg26673070 | — | — | 0.05 | 0.84 | 0.92 | 0.92 | 0.92 | 0.92 |
| bGRC_nm15 | cg24130568 | TBCD | NM_005993 | 0.04 | 0.88 | 0.92 | 0.85 | 0.78 | 0.94 |
| bGRC_nm16 | cg04498104 | PFKFB4 | NM_004567 | 0.06 | 0.80 | 0.91 | 0.90 | 0.91 | 0.84 |
| bGRC_nm17 | cg12037509 | DPYSL2 | NM_001386 | 0.07 | 0.84 | 0.92 | 0.93 | 0.91 | 0.93 |
| bGRC_nm18 | cg11294011 | — | — | 0.08 | 0.92 | 0.94 | 0.93 | 0.93 | 0.91 |
| bGRC_nm19 | cg02752529 | FBXL14 | NM_152441 | 0.04 | 0.71 | 0.89 | 0.90 | 0.90 | 0.89 |
| bGRC_nm20 | cg02426739 | SGSWAP | NM_004592; NM_001261411 | 0.05 | 0.75 | 0.91 | 0.92 | 0.91 | 0.61 |
| bGRC_nm21 | cg12087639 | ADK | NM_001123 | 0.09 | 0.89 | 0.95 | 0.92 | 0.92 | 0.91 |
| bGRC_nm22 | cg10319857 | NFAT5 | NM_138714 | 0.04 | 0.60 | 0.91 | 0.91 | 0.88 | 0.90 |
| bGRC_nm23 | cg21715896 | — | — | 0.06 | 0.78 | 0.88 | 0.90 | 0.87 | 0.90 |
| bGRC_nm24 | cg14200678 | MEGF9 | NM_001080497 | 0.08 | 0.82 | 0.91 | 0.89 | 0.89 | 0.90 |
| bGRC_nm25 | cg20964248 | SIK2 | NM_015191 | 0.04 | 0.80 | 0.90 | 0.85 | 0.85 | 0.89 |
| bGRC_nm26 | cg03380342 | — | — | 0.07 | 0.85 | 0.91 | 0.91 | 0.90 | 0.90 |
| bGRC_nm27 | cg07818422 | WDFY2 | NM_052950 | 0.05 | 0.64 | 0.92 | 0.92 | 0.91 | 0.90 |
| bGRC_nm28 | cg23639055 | — | — | 0.07 | 0.84 | 0.90 | 0.90 | 0.90 | 0.89 |
| bGRC_nm29 | cg00086283 | — | — | 0.11 | 0.88 | 0.94 | 0.95 | 0.94 | 0.94 |
| bGRC_nm30 | cg12018521 | TES | NM_015641 | 0.06 | 0.84 | 0.90 | 0.90 | 0.88 | 0.65 |
| bGRC_nm31 | cg12486498 | C1orf198 | NM_001136494 | 0.12 | 0.88 | 0.94 | 0.93 | 0.93 | 0.95 |
| bGRC_nm32 | cg19699264 | SDPR | NM_004657 | 0.07 | 0.88 | 0.92 | 0.90 | 0.91 | 0.92 |
| bGRC_nm33 | cg05865769 | MAP2K4 | NM_003010 | 0.08 | 0.75 | 0.91 | 0.92 | 0.89 | 0.90 |
| bGRC_nm34 | cg11809342 | TANC1 | NM_033394 | 0.08 | 0.76 | 0.91 | 0.92 | 0.91 | 0.89 |
| bGRC_nm35 | cg02800334 | ANXA13 | NM_001003954 | 0.05 | 0.80 | 0.88 | 0.88 | 0.86 | 0.87 |
| bGRC_nm36 | cg09151061 | ZNF366 | NM_152625 | 0.09 | 0.90 | 0.92 | 0.92 | 0.91 | 0.90 |
| bGRC_nm37 | cg14633252 | SHB | NM_003028 | 0.05 | 0.78 | 0.89 | 0.81 | 0.80 | 0.90 |
| bGRC_nm38 | cg09473249 | ABCC1 | NM_019862 | 0.07 | 0.73 | 0.88 | 0.90 | 0.89 | 0.90 |
| bGRC_nm39 | cg19975917 | LPP | NM_005578 | 0.07 | 0.63 | 0.90 | 0.91 | 0.90 | 0.89 |
| bGRC_nm40 | cg02387491 | LIN7A; MIR617 | NM_004664 | 0.08 | 0.63 | 0.92 | 0.91 | 0.91 | 0.90 |
| bGRC_nm41 | cg24143196 | TECR | NM_138501 | 0.08 | 0.66 | 0.91 | 0.93 | 0.93 | 0.78 |
| bGRC_nm42 | cg22609618 | CDC14A | NM_003672 | 0.07 | 0.88 | 0.87 | 0.91 | 0.88 | 0.88 |
| bGRC_nm43 | cg24791846 | — | — | 0.09 | 0.85 | 0.91 | 0.89 | 0.89 | 0.92 |
| bGRC_nm44 | cg10330847 | — | — | 0.06 | 0.65 | 0.90 | 0.91 | 0.89 | 0.73 |
| bGRC_nm45 | cg04988216 | ROR1 | NM_005012 | 0.13 | 0.90 | 0.91 | 0.94 | 0.94 | 0.92 |
| bGRC_nm46 | cg26009797 | — | — | 0.06 | 0.78 | 0.86 | 0.89 | 0.87 | 0.87 |
| bGRC_nm47 | cg24736010 | — | — | 0.08 | 0.82 | 0.91 | 0.91 | 0.91 | 0.89 |
| bGRC_nm48 | cg04657468 | ARID5B | NM_032199 | 0.09 | 0.70 | 0.88 | 0.91 | 0.87 | 0.89 |
| bGRC_nm49 | cg04023434 | RGL1 | NM_015149 | 0.10 | 0.69 | 0.92 | 0.90 | 0.93 | 0.90 |
| bGRC_nm50 | cg15192986 | CPB2 | NM_016413 | 0.09 | 0.82 | 0.88 | 0.89 | 0.87 | 0.90 |
| eGRC_nm2 | cg15090899 | RPS6KA2 | NM_001006932 | 0.97 | 0.16 | 0.83 | 0.95 | 0.96 | 0.78 |

TABLE 4G-continued

Granolucytes and Subtypes Marker

| | | | | | | | | | |
|---|---|---|---|---|---|---|---|---|---|
| eGRC_nm3 | cg20761853 | TIMP2 | NM_003255 | 0.74 | 0.13 | 0.61 | 0.93 | 0.94 | 0.91 |
| eGRC_nm4 | cg11900509 | ANXA11 | NM_145868 | 0.92 | 0.13 | 0.62 | 0.98 | 0.98 | 0.97 |
| eGRC_nm5 | cg03269757 | ATL2 | NM_022374 | 0.52 | 0.14 | 0.78 | 0.88 | 0.87 | 0.93 |
| eGRC_nm6 | cg09411597 | C10orf18 | NM_017782 | 0.82 | 0.13 | 0.61 | 0.87 | 0.86 | 0.88 |
| eGRC_nm7 | cg13872812 | BBX | NM_020235 | 0.81 | 0.22 | 0.95 | 0.95 | 0.95 | 0.96 |
| eGRC_nm8 | cg21237481 | — | — | 0.80 | 0.17 | 0.76 | 0.87 | 0.87 | 0.93 |
| eGRC_nm9 | cg23060513 | FARSA | NM_004461 | 0.85 | 0.18 | 0.54 | 0.83 | 0.89 | 0.93 |
| eGRC_nm10 | cg08742095 | CALU | NM_001219 | 0.81 | 0.15 | 0.57 | 0.89 | 0.92 | 0.88 |
| eGRC_nm11 | cg22011526 | C6orf89 | NM_152734 | 0.88 | 0.16 | 0.59 | 0.85 | 0.86 | 0.90 |
| eGRC_nm12 | cg24520381 | PPP1R1B | NM_181505 | 0.85 | 0.16 | 0.73 | 0.86 | 0.89 | 0.90 |
| eGRC_nm13 | cg10454864 | — | — | 0.54 | 0.21 | 0.93 | 0.94 | 0.93 | 0.92 |
| eGRC_nm14 | cg10387956 | HEXA | NM_000520 | 0.62 | 0.14 | 0.81 | 0.84 | 0.84 | 0.85 |
| eGRC_nm15 | cg18898103 | ETS1 | NM_001143820 | 0.86 | 0.16 | 0.53 | 0.87 | 0.84 | 0.89 |
| eGRC_nm16 | cg00006459 | — | — | 0.78 | 0.19 | 0.87 | 0.90 | 0.89 | 0.89 |
| eGRC_nm17 | cg20240243 | MEF2A | NM_001130927 | 0.68 | 0.18 | 0.91 | 0.87 | 0.85 | 0.87 |
| eGRC_nm18 | cg23990557 | IGF1R | NM_000875 | 0.86 | 0.17 | 0.59 | 0.86 | 0.90 | 0.88 |
| eGRC_nm19 | cg19788934 | C12orf43 | NM_022895 | 0.79 | 0.18 | 0.70 | 0.86 | 0.84 | 0.86 |
| eGRC_nm20 | cg11668148 | HEXA | NM_000520 | 0.87 | 0.19 | 0.87 | 0.89 | 0.86 | 0.87 |
| eGRC_nm21 | cg16386158 | IL1RL1 | NM_016232 | 0.56 | 0.18 | 0.83 | 0.91 | 0.92 | 0.74 |
| eGRC_nm22 | cg26234644 | TMEM220 | NM_001004313 | 0.69 | 0.18 | 0.70 | 0.75 | 0.73 | 0.91 |
| eGRC_nm23 | cg25381747 | — | — | 0.71 | 0.18 | 0.85 | 0.86 | 0.83 | 0.86 |
| eGRC_nm24 | cg22221575 | PCYT1A | NM_005017 | 0.57 | 0.16 | 0.82 | 0.82 | 0.81 | 0.85 |
| eGRC_nm25 | cg11310939 | MARCH3 | NM_178450 | 0.60 | 0.21 | 0.89 | 0.91 | 0.88 | 0.89 |
| eGRC_nm26 | cg09596645 | — | — | 0.82 | 0.20 | 0.85 | 0.83 | 0.84 | 0.86 |
| eGRC_nm27 | cg00391067 | LOC100-271715 | NM_001145451 | 0.70 | 0.17 | 0.72 | 0.76 | 0.77 | 0.88 |
| eGRC_nm28 | cg01835368 | C7orf36 | NM_020192 | 0.74 | 0.15 | 0.58 | 0.71 | 0.73 | 0.80 |
| eGRC_nm29 | cg16797699 | — | — | 0.74 | 0.16 | 0.66 | 0.74 | 0.76 | 0.74 |
| eGRC_nm30 | cg13953978 | USP20 | NM_001110303 | 0.61 | 0.20 | 0.83 | 0.86 | 0.85 | 0.83 |
| eGRC_nm31 | cg17572056 | OSTalpha | NM_152672 | 0.98 | 0.11 | 0.27 | 0.95 | 0.98 | 0.98 |
| eGRC_nm32 | cg04836151 | — | — | 0.98 | 0.15 | 0.49 | 0.84 | 0.86 | 0.98 |
| eGRC_nm33 | cg02803925 | PCYT1A | NM_005017 | 0.97 | 0.21 | 0.95 | 0.99 | 0.99 | 0.98 |
| eGRC_nm34 | cg00421164 | RREB1 | NM_001003700 | 0.87 | 0.12 | 0.39 | 0.86 | 0.87 | 0.91 |
| eGRC_nm35 | cg03695871 | DKFZp7-61E198 | NM_138368 | 0.89 | 0.17 | 0.51 | 0.84 | 0.91 | 0.93 |
| eGRC_nm36 | cg26921611 | EIF4EBP1 | NM_004095 | 0.77 | 0.10 | 0.47 | 0.71 | 0.79 | 0.88 |
| eGRC_nm37 | cg15171342 | TMED3 | NM_007364 | 0.82 | 0.21 | 0.77 | 0.93 | 0.92 | 0.92 |
| eGRC_nm38 | cg05736642 | HTT | NM_002111 | 0.89 | 0.22 | 0.82 | 0.92 | 0.92 | 0.92 |
| eGRC_nm39 | cg23039807 | — | — | 0.86 | 0.14 | 0.45 | 0.73 | 0.79 | 0.90 |
| eGRC_nm40 | cg04128967 | — | — | 0.41 | 0.12 | 0.83 | 0.79 | 0.82 | 0.90 |
| eGRC_nm41 | cg11183227 | MAN2A2 | NM_006122 | 0.98 | 0.27 | 0.75 | 0.98 | 0.98 | 0.98 |
| eGRC_nm42 | cg23037469 | DCAF5 | NM_003861 | 0.89 | 0.16 | 0.44 | 0.86 | 0.87 | 0.89 |
| eGRC_nm43 | cg25578728 | CHD7 | NM_017780 | 0.85 | 0.20 | 0.78 | 0.91 | 0.89 | 0.92 |
| eGRC_nm44 | cg12910830 | MAT2B | NM_182796 | 0.73 | 0.21 | 0.87 | 0.91 | 0.90 | 0.91 |
| eGRC_nm45 | cg08077807 | PRKCH | NM_006255 | 0.74 | 0.20 | 0.92 | 0.92 | 0.93 | 0.82 |
| eGRC_nm46 | cg14209186 | TMEM156 | NM_024943 | 0.75 | 0.21 | 0.76 | 0.80 | 0.87 | 0.92 |
| eGRC_nm47 | cg05078091 | APLP2 | NR_024516 | 0.58 | 0.23 | 0.92 | 0.93 | 0.93 | 0.92 |
| eGRC_nm48 | cg19764973 | STX3 | NM_004177 | 0.87 | 0.24 | 0.87 | 0.91 | 0.90 | 0.91 |
| eGRC_nm49 | cg25203627 | TSNAX-DISC1 | NR_028394 | 0.89 | 0.25 | 0.80 | 0.89 | 0.91 | 0.92 |
| eGRC_nm50 | cg22106847 | DMXL1 | NM_005509 | 0.89 | 0.26 | 0.82 | 0.90 | 0.91 | 0.90 |
| eGRC_nm51 | cg17960717 | — | — | 0.90 | 0.28 | 0.87 | 0.92 | 0.89 | 0.93 |
| nGRC_nm1 | cg03146219 | NADSYN1 | NM_018161 | 0.98 | 0.88 | 0.07 | 0.97 | 0.98 | 0.97 |
| nGRC_nm3 | cg13785123 | ENO1 | NM_001428 | 0.95 | 0.78 | 0.04 | 0.88 | 0.92 | 0.96 |
| nGRC_nm4 | cg23819411 | MCF2L2 | NM_015078 | 0.95 | 0.69 | 0.03 | 0.78 | 0.86 | 0.96 |
| GRC_18nm | cg25600606 | HIPK3 | NM_001048200 | 0.91 | 0.77 | 0.04 | 0.87 | 0.87 | 0.92 |
| nGRC_nm7 | cg25074794 | MARCH8 | NM_001002265 | 0.90 | 0.56 | 0.04 | 0.83 | 0.90 | 0.95 |
| nGRC_nm8 | cg13618969 | FAM125B | NM_033446 | 0.88 | 0.76 | 0.03 | 0.89 | 0.91 | 0.90 |
| nGRC_nm9 | cg26056277 | — | — | 0.93 | 0.68 | 0.05 | 0.80 | 0.84 | 0.96 |
| nGRC_nm10 | cg11153071 | RPTOR | NM_001163034 | 0.97 | 0.85 | 0.06 | 0.60 | 0.77 | 0.97 |
| nGRC_nm11 | cg01498832 | RPTOR | NM_001163034 | 0.86 | 0.76 | 0.12 | 0.61 | 0.70 | 0.86 |
| nGRC_nm12 | cg21090866 | VPS53 | NM_018289 | 0.91 | 0.87 | 0.07 | 0.92 | 0.93 | 0.88 |
| nGRC_nm13 | cg05971678 | CHST15 | NM_015892 | 0.93 | 0.66 | 0.04 | 0.61 | 0.73 | 0.97 |
| nGRC_nm15 | cg09694051 | MED21 | NM_004264 | 0.87 | 0.75 | 0.01 | 0.80 | 0.84 | 0.88 |
| nGRC_nm16 | cg24131359 | CPM | NM_001874 | 0.96 | 0.91 | 0.13 | 0.94 | 0.98 | 0.96 |
| nGRC_nm17 | cg13984928 | ITGAE | NM_002208 | 0.97 | 0.75 | 0.04 | 0.58 | 0.61 | 0.85 |
| nGRC_nm20 | cg13468144 | ANKFY1 | NM_016376 | 0.90 | 0.72 | 0.04 | 0.90 | 0.91 | 0.91 |
| nGRC_nm22 | cg01699630 | ARG1 | NM_000045 | 0.91 | 0.74 | 0.05 | 0.90 | 0.88 | 0.87 |
| nGRC_nm24 | cg10934870 | PCYOX1 | NM_016297 | 0.90 | 0.85 | 0.05 | 0.85 | 0.90 | 0.89 |
| nGRC_nm25 | cg26396370 | KLF11 | NM_003597 | 0.83 | 0.75 | 0.05 | 0.81 | 0.83 | 0.91 |
| nGRC_nm26 | cg25693317 | SH3PXD2B | NM_001017995 | 0.90 | 0.75 | 0.08 | 0.84 | 0.89 | 0.91 |
| nGRC_nm28 | cg12031275 | — | — | 0.95 | 0.77 | 0.11 | 0.76 | 0.81 | 0.95 |
| nGRC_nm29 | cg23128584 | DIP2C | NM_014974 | 0.85 | 0.51 | 0.05 | 0.66 | 0.81 | 0.91 |
| nGRC_nm30 | cg02279108 | — | — | 0.87 | 0.74 | 0.06 | 0.89 | 0.90 | 0.88 |
| nGRC_nm31 | cg25757820 | — | — | 0.92 | 0.76 | 0.08 | 0.74 | 0.76 | 0.90 |
| nGRC_nm32 | cg06465076 | CAST | NM_001750 | 0.76 | 0.59 | 0.07 | 0.76 | 0.83 | 0.91 |
| nGRC_nm33 | cg27510066 | CSGALNACT1 | NR_024040 | 0.87 | 0.67 | 0.06 | 0.79 | 0.83 | 0.89 |
| nGRC_nm34 | cg06784232 | CSGALNACT1 | NR_024040 | 0.83 | 0.79 | 0.24 | 0.83 | 0.86 | 0.84 |

TABLE 4G-continued

Granulocytes and Subtypes Marker

| | | | | | | | | | |
|---|---|---|---|---|---|---|---|---|---|
| nGRC_nm35 | cg01040749 | INPP5A | NM_005539 | 0.85 | 0.51 | 0.08 | 0.82 | 0.86 | 0.91 |
| nGRC_nm36 | cg07102397 | FOXN3 | NM_005197 | 0.88 | 0.72 | 0.10 | 0.86 | 0.86 | 0.92 |
| nGRC_nm37 | cg13633625 | — | — | 0.82 | 0.67 | 0.05 | 0.64 | 0.67 | 0.92 |
| nGRC_nm38 | cg23338668 | — | — | 0.87 | 0.83 | 0.07 | 0.87 | 0.86 | 0.88 |
| nGRC_nm39 | cg22400420 | RGL1 | NM_015149 | 0.87 | 0.78 | 0.07 | 0.84 | 0.88 | 0.84 |
| nGRC_nm40 | cg24737761 | — | — | 0.86 | 0.54 | 0.06 | 0.81 | 0.83 | 0.85 |
| nGRC_nm41 | cg23911433 | — | — | 0.87 | 0.81 | 0.05 | 0.78 | 0.87 | 0.85 |
| nGRC_nm42 | cg09010699 | — | — | 0.87 | 0.79 | 0.07 | 0.67 | 0.69 | 0.89 |
| nGRC_nm43 | cg06633438 | MLLT1 | NM_005934 | 0.92 | 0.79 | 0.09 | 0.73 | 0.80 | 0.90 |
| nGRC_nm44 | cg16000989 | DCAF4L1 | NM_001029955 | 0.94 | 0.73 | 0.11 | 0.67 | 0.76 | 0.94 |
| nGRC_nm45 | cg03610527 | HDLBP | NM_203346 | 0.84 | 0.57 | 0.10 | 0.70 | 0.72 | 0.93 |
| nGRC_nm46 | cg17419815 | C12orf71 | NM_001080406 | 0.89 | 0.67 | 0.07 | 0.61 | 0.65 | 0.91 |
| nGRC_nm47 | cg06059360 | NKTR | NM_005385 | 0.75 | 0.71 | 0.09 | 0.74 | 0.78 | 0.87 |
| nGRC_nm48 | cg07052231 | PEX5 | NM_001131023 | 0.86 | 0.73 | 0.09 | 0.70 | 0.81 | 0.87 |
| nGRC_nm49 | cg02368812 | NQO2 | NM_000904 | 0.96 | 0.79 | 0.19 | 0.80 | 0.83 | 0.97 |
| nGRC_nm50 | cg05418105 | — | — | 0.88 | 0.66 | 0.08 | 0.58 | 0.62 | 0.91 |

| Marker-ID | B-Cells | CD4+ Th naive | CD4+ Th1 | CD4+ Th2 | CD4+ Th Central Mem. | CD4+ Th Effect. Mem. | CD8+ Cytotoxic T-Cells | NK T-Cells | Discovery Fragment |
|---|---|---|---|---|---|---|---|---|---|
| GRC_nm38 | 0.87 | 0.90 | 0.86 | 0.87 | 0.88 | 0.87 | 0.89 | 0.86 | CGGCCTGGGCGTGGTC TTGCAAAATGCTTCCA AAGCCACCTTAGCCTG TT (SEQ ID NO: 1051) |
| GRC_nm39 | 0.91 | 0.90 | 0.91 | 0.92 | 0.92 | 0.91 | 0.92 | 0.92 | CCACAGACCCTTTCTC CTTCACTGATTACAGA ATCATACCAAGCACA GCG (SEQ ID NO: 1052) |
| GRC_nm40 | 0.87 | 0.92 | 0.87 | 0.89 | 0.88 | 0.87 | 0.89 | 0.85 | TGGGCCTGGTGCTTGG GTTTGCTAACTTCTGG TTCTTCATGTGTATCA CG (SEQ ID NO: 1053) |
| GRC_nm41 | 0.87 | 0.89 | 0.86 | 0.87 | 0.88 | 0.87 | 0.89 | 0.84 | CGACATGGGCAATGT GGGGAAAGAGACCAT TGTGTAAATGATCTAC AATG (SEQ ID NO: 1054) |
| GRC_nm42 | 0.87 | 0.89 | 0.86 | 0.87 | 0.89 | 0.89 | 0.91 | 0.85 | CGAAGGCCAGAGCCT GTTTGTAAACCATTAA CAGGAATAACAAGAG ATAA (SEQ ID NO: 1055) |
| GRC_nm43 | 0.91 | 0.91 | 0.86 | 0.89 | 0.89 | 0.88 | 0.91 | 0.84 | GACCGAGGCCGACAA TTCAGTCGCCACACAA GAGGTCAGAAATATA CTCG (SEQ ID NO: 1056) |
| GRC_nm44 | 0.91 | 0.92 | 0.90 | 0.91 | 0.91 | 0.90 | 0.89 | 0.88 | TGGGGATAAACGGTG TAACACTGGGGCAGG TCAGTTTCCTTGTTGG TACG (SEQ ID NO: 1057) |
| GRC_nm45 | 0.85 | 0.93 | 0.75 | 0.83 | 0.87 | 0.84 | 0.85 | 0.73 | TTTGAGGAAAATACCT TGAAACCGTCGGTAG GACTAGATAGGTGAC AACG (SEQ ID NO: 1058) |
| GRC_nm46 | 0.74 | 0.86 | 0.67 | 0.68 | 0.76 | 0.73 | 0.78 | 0.70 | CGTCTTGGTGATAACA GGCACTTGAGAAATA AGTTTTTAAAGAGTTG ATT (SEQ ID NO: 1059) |
| GRC_nm47 | 0.89 | 0.87 | 0.89 | 0.89 | 0.90 | 0.89 | 0.88 | 0.90 | AACACAGTGTGGGCT GATGCAATCAGTGTTT GCTGCCCTTGGGCGCT TCG (SEQ ID NO: 1060) |
| GRC_nm48 | 0.87 | 0.90 | 0.85 | 0.85 | 0.85 | 0.84 | 0.87 | 0.82 | CGGGCAGATTTTTTCA GAGCAATTGAATGTAT TCAAAGATGTCTTAAT TA (SEQ ID NO: 1061) |
| GRC_nm49 | 0.96 | 0.94 | 0.96 | 0.96 | 0.96 | 0.97 | 0.96 | 0.95 | GAAGCTGGGGCAGGT AACACGCAGAGCCGC CACGTGGAACGGTCT GTCCG (SEQ ID NO: 1062) |

TABLE 4G-continued

Granolucytes and Subtypes Marker

| | | | | | | | | | |
|---|---|---|---|---|---|---|---|---|---|
| GRC_nm50 | 0.91 | 0.67 | 0.69 | 0.66 | 0.70 | 0.71 | 0.65 | 0.61 | GGAGGCACTTGTAGCT GAGTGAGGGCATTTCC TTTGTGCAGTGGTATG CG (SEQ ID NO: 1063) |
| GRC_nm51 | 0.90 | 0.89 | 0.91 | 0.89 | 0.90 | 0.89 | 0.90 | 0.88 | TTCTTGTTATCTCATTT AGGACTCATAACTCA GTTGTGTAAGCTTTAT CG (SEQ ID NO: 1064) |
| GRC_nm52 | 0.89 | 0.88 | 0.87 | 0.84 | 0.86 | 0.87 | 0.88 | 0.87 | CTATCACTAGACATA TCCTCTCTTTAGAGAA ATCACACAAAATTCTA CG (SEQ ID NO: 1065) |
| GRC_nm53 | 0.87 | 0.87 | 0.84 | 0.84 | 0.84 | 0.87 | 0.89 | 0.81 | AGGATTTGCTCTCCA GATGCAGCTGTGCCTT CCTTTGAAATATCTTT CG (SEQ ID NO: 1066) |
| GRC_nm54 | 0.86 | 0.55 | 0.83 | 0.85 | 0.79 | 0.87 | 0.74 | 0.87 | TCTTGAGAAATGTACT TTAGACTAGCTTGAGT TGACACATTACAAAGT CG (SEQ ID NO: 1067) |
| GRC_nm55 | 0.87 | 0.84 | 0.84 | 0.81 | 0.88 | 0.79 | 0.83 | 0.85 | CGGTATCAGCAATTGA AGCATTACAGTAAAA GACCTCCGATTACCAA CTG (SEQ ID NO: 1068) |
| GRC_nm56 | 0.87 | 0.89 | 0.85 | 0.85 | 0.86 | 0.86 | 0.88 | 0.79 | CGGCCCCTTCTGACCC CATAGCTGGCACGGG CTCCTGACCACAGGTA TGC (SEQ ID NO: 1069) |
| GRC_nm57 | 0.89 | 0.91 | 0.90 | 0.85 | 0.90 | 0.89 | 0.89 | 0.90 | TGCCCCGGTGGTGCAG TCAGTGGAAGCAGCT GTAATCTATGGGGTCA TCG (SEQ ID NO: 1070) |
| GRC_nm58 | 0.66 | 0.97 | 0.96 | 0.96 | 0.97 | 0.94 | 0.98 | 0.96 | CGGTGTCACAAGAAA ACCTTGCAGACTCGCC CTCGTAGACGGTCATG GAC (SEQ ID NO: 1071) |
| GRC_nm59 | 0.94 | 0.87 | 0.85 | 0.82 | 0.87 | 0.87 | 0.79 | 0.77 | CGTGGTACATGAGAA CCTTACTATAAAGTGG CTCTTTAGGACCGTTC TGA (SEQ ID NO: 1072) |
| GRC_nm60 | 0.92 | 0.92 | 0.88 | 0.85 | 0.90 | 0.89 | 0.92 | 0.91 | CATGAACTCTCTGCGT TCCAAACTATAGATTG TGATTAATTATTTTGT CG (SEQ ID NO: 1073) |
| GRC_nm61 | 0.84 | 0.77 | 0.56 | 0.60 | 0.66 | 0.63 | 0.73 | 0.38 | GCACCCCAGTTATCTA GCCCTCATCAATTTGT GCAAGAAGGCCGGGC TCG (SEQ ID NO: 1074) |
| GRC_nm62 | 0.92 | 0.90 | 0.91 | 0.92 | 0.92 | 0.92 | 0.92 | 0.92 | CGCAAGTGATTTATAT GCATTGTCTTTGCAGC CACTCTATGAGGCAG ACA (SEQ ID NO: 1075) |
| GRC_nm63 | 0.90 | 0.92 | 0.86 | 0.81 | 0.85 | 0.87 | 0.89 | 0.88 | CCACTCTGACCTTAGA CAAGTTACTTAATTGT CTCAGTGCCTTGGTTT CG (SEQ ID NO: 1076) |
| GRC_nm64 | 0.89 | 0.93 | 0.86 | 0.79 | 0.87 | 0.81 | 0.90 | 0.87 | ATTTCATCAACTGTCC CACTAACATCCTGTAT ATACCAAGCTTCTTAT CG (SEQ ID NO: 1077) |
| GRC_nm65 | 0.90 | 0.90 | 0.87 | 0.86 | 0.89 | 0.89 | 0.91 | 0.87 | CGCTTTGGAAGAAGG ATTAGGTAATTGTAGT ACAATCTTCCACCCAG TTC (SEQ ID NO: 1078) |
| GRC_nm66 | 0.95 | 0.95 | 0.95 | 0.95 | 0.95 | 0.95 | 0.96 | 0.93 | CGGACCTCAAGTCCCT GTGCTAGCCACGGTA GTTCTTCACACCCCGT CAC (SEQ ID NO: 1079) |
| GRC_nm67 | 0.76 | 0.93 | 0.56 | 0.88 | 0.75 | 0.66 | 0.82 | 0.61 | ATGGCGGATATGTATG CAACGCGTGTGGCCTC TACCAGAAGCTTCACT CG (SEQ ID NO: 1080) |
| GRC_nm68 | 0.52 | 0.73 | 0.90 | 0.88 | 0.85 | 0.88 | 0.89 | 0.91 | AGGTAGCCATGCTGCT AAGGTCACAGTCACT AAGATATTTTTTGTCA TCG (SEQ ID NO: 1081) |

TABLE 4G-continued

Granolucytes and Subtypes Marker

| | | | | | | | | | |
|---|---|---|---|---|---|---|---|---|---|
| GRC_nm69 | 0.97 | 0.97 | 0.97 | 0.96 | 0.98 | 0.97 | 0.97 | 0.97 | GGTTACGGGGCAGTG GCCATGAGCCTCTGTC GGACTGACGCAAGGA GCCG (SEQ ID NO: 1082) |
| GRC_nm70 | 0.77 | 0.86 | 0.55 | 0.61 | 0.70 | 0.60 | 0.70 | 0.34 | AAAAAATAGACAACC TCCCAGTTGCCACAGA CATGTACTGTAAGCAG ACG (SEQ ID NO: 1083) |
| GRC_nm71 | 0.92 | 0.89 | 0.88 | 0.86 | 0.88 | 0.86 | 0.91 | 0.87 | CGGGAAATACACATT ATGCTAATGTTGATGA CAGAATTTATTTGGTT GCC (SEQ ID NO: 1084) |
| GRC_nm72 | 0.87 | 0.86 | 0.86 | 0.84 | 0.86 | 0.87 | 0.88 | 0.80 | CGGTGCCATCTTGTGA AAGGGCTCTGCAGC TTTTAATGTGTACAGT TTC (SEQ ID NO: 1085) |
| GRC_nm73 | 0.90 | 0.91 | 0.90 | 0.89 | 0.90 | 0.90 | 0.91 | 0.88 | GGCCTACATTCTGTAC TTTGTGCTGAAGGAGT TCTGCATCATCTGCAT CG (SEQ ID NO: 1086) |
| GRC_nm74 | 0.86 | 0.87 | 0.85 | 0.85 | 0.87 | 0.86 | 0.88 | 0.86 | CGTGACGATGCAGAT GATGCAGAACTCCTTC AGCACAAAGTACAGA ATGT (SEQ ID NO: 1087) |
| GRC_nm75 | 0.69 | 0.88 | 0.90 | 0.91 | 0.92 | 0.92 | 0.92 | 0.89 | CGCCAGCCTGCATTTT AGATGGACCATAACT CAAGATAGGCGTTGA AGCA (SEQ ID NO: 1088) |
| GRC_nm76 | 0.86 | 0.89 | 0.84 | 0.85 | 0.86 | 0.86 | 0.86 | 0.79 | CGAGGGCACTGGACA TGCTGGATTTGGGGAG ACTGTTATGCGATCTC AAA (SEQ ID NO: 1089) |
| GRC_nm77 | 0.76 | 0.85 | 0.75 | 0.76 | 0.74 | 0.74 | 0.77 | 0.58 | CAGAGGAAGCCACAT AACCTCAAAAGGTCA AGACACCTAGACATG GTCCG (SEQ ID NO: 1090) |
| GRC_nm78 | 0.90 | 0.89 | 0.90 | 0.89 | 0.88 | 0.87 | 0.89 | 0.86 | CAACCTGTCCACTCGG TTTTCTGTTTCTTTGAG ATTATTTTCTACTAAC G (SEQ ID NO: 1091) |
| GRC_nm79 | 0.92 | 0.90 | 0.92 | 0.93 | 0.91 | 0.94 | 0.93 | 0.93 | CGGTGTGATGTGATGA AATCAGGATTTTGTGT AAGCTAGCTCTCAAG AAA (SEQ ID NO: 1092) |
| GRC_nm80 | 0.91 | 0.90 | 0.51 | 0.59 | 0.62 | 0.56 | 0.80 | 0.47 | ATCCTGCTTCCATGGA GTAAAATTCCAGACTG GGACAAGCGTTCTTTC CG (SEQ ID NO: 1093) |
| GRC_nm81 | 0.78 | 0.80 | 0.71 | 0.76 | 0.75 | 0.77 | 0.82 | 0.68 | CGTGTCTCTTTAAAGC TGCTATGTGAACAGCT TTTACAGTCATTAAAT TT (SEQ ID NO: 1094) |
| GRC_nm82 | 0.88 | 0.89 | 0.89 | 0.89 | 0.90 | 0.90 | 0.90 | 0.87 | TGTATGTCCAGCTGGA CTTGGCAGAAGTACA CAGACTGGTCCTCCTT CCG (SEQ ID NO: 1095) |
| GRC_nm83 | 0.50 | 0.81 | 0.82 | 0.80 | 0.82 | 0.82 | 0.85 | 0.80 | GACACATGATCCTCGG GCTGCTGCTGGGCTTT AGCTACCCAGAGATT ACG (SEQ ID NO: 1096) |
| GRC_nm84 | 0.80 | 0.84 | 0.86 | 0.85 | 0.83 | 0.87 | 0.87 | 0.86 | ATTTCCTATGGCCAGT GTTCTACAGAAGTAA GACTGTGCAAACTTTA TCG (SEQ ID NO: 1097) |
| GRC_nm85 | 0.90 | 0.90 | 0.85 | 0.87 | 0.88 | 0.85 | 0.90 | 0.88 | GGCTTCTGACTGGAGG ACAATGACCCAGCTG ATCCTTCTGACGTCTT ACG (SEQ ID NO: 1098) |
| bGRC_nm1 | 0.91 | 0.91 | 0.91 | 0.91 | 0.90 | 0.91 | 0.91 | 0.89 | AAGAAAGAACCCTTT AAATAAGGGCCCAC ACTGGCTGCCAGG GA GTGCG (SEQ ID NO: 1099) |

TABLE 4G-continued

Granulocytes and Subtypes Marker

| | | | | | | | | | |
|---|---|---|---|---|---|---|---|---|---|
| bGRC_nm2 | 0.96 | 0.95 | 0.97 | 0.96 | 0.96 | 0.96 | 0.94 | 0.95 | CGGGGGGCCACCGAA TACTCCCCGAGCGCAT ACTATTTACAGAAGA GTCA (SEQ ID NO: 1100) |
| bGRC_nm3 | 0.96 | 0.96 | 0.96 | 0.97 | 0.97 | 0.97 | 0.97 | 0.97 | GACGTGCAGATAACG TTGAGCTGCCCTGTCC CCGAGCCATAAGCAG AGCG (SEQ ID NO: 1101) |
| bGRC_nm4 | 0.96 | 0.95 | 0.96 | 0.95 | 0.96 | 0.94 | 0.95 | 0.96 | CGGTCACTTCCAGGTT TTGACGATCATGAATA ACGTTTCTGTCGACAT CT (SEQ ID NO: 1102) |
| bGRC_nm5 | 0.96 | 0.96 | 0.96 | 0.96 | 0.95 | 0.96 | 0.96 | 0.96 | CGCCTATCGGCCCATC TCCCTGCTGTCCATCA GGCCGGGCCCCCGCCT CA (SEQ ID NO: 1103) |
| bGRC_nm6 | 0.92 | 0.89 | 0.89 | 0.89 | 0.89 | 0.91 | 0.91 | 0.90 | CGTCCTAGACACCCTG GCCTGGAAACTAGGA CATCTGCCTCGGGCCT GTT (SEQ ID NO: 1104) |
| bGRC_nm7 | 0.89 | 0.90 | 0.86 | 0.87 | 0.88 | 0.87 | 0.88 | 0.85 | CGCTGCAGCAGATGG TCTTGGAAATACAACA GGCTGCATTCTAACTG CTG (SEQ ID NO: 1105) |
| bGRC_nm8 | 0.91 | 0.91 | 0.91 | 0.92 | 0.90 | 0.91 | 0.92 | 0.92 | ATAACTTGGAGGCAG CGTAGATGGCGCCTG GTGACTGCAGTGTGCC CACG (SEQ ID NO: 1106) |
| bGRC_nm9 | 0.85 | 0.89 | 0.76 | 0.78 | 0.81 | 0.80 | 0.84 | 0.71 | CGTCAGGGCTGTGGTG ATGAAGTCCAGATGTT ATAACTTAACAGTGTT TT (SEQ ID NO: 1107) |
| bGRC_nm10 | 0.86 | 0.91 | 0.85 | 0.85 | 0.87 | 0.86 | 0.88 | 0.82 | GGCCTGCTGTCCCACT GCCATGCTCATCTGCA TATGTATGGTTTCATT CG (SEQ ID NO: 1108) |
| bGRC_nm11 | 0.93 | 0.92 | 0.92 | 0.93 | 0.92 | 0.93 | 0.93 | 0.93 | CGCTAATGCCAAGAT AAGCTAATGCTGTGCT TCACCTGGACACAGG GAAA (SEQ ID NO: 1109) |
| bGRC_nm12 | 0.98 | 0.97 | 0.96 | 0.96 | 0.96 | 0.96 | 0.97 | 0.96 | TCACCTGCGGAGGAC CCCGTGCTGGGGAGG TGGTGGCTGGTAGTGA GACG (SEQ ID NO: 1110) |
| bGRC_nm13 | 0.93 | 0.93 | 0.94 | 0.93 | 0.93 | 0.91 | 0.94 | 0.94 | CGAAGGCTTTGTAATT CACAGTGATAAGTGC AGTTAATATGTTATCT GAT (SEQ ID NO: 1111) |
| bGRC_nm14 | 0.91 | 0.92 | 0.92 | 0.91 | 0.91 | 0.91 | 0.92 | 0.93 | ACTGCCCATTTTTAA AACTTCAAATCCAAA AGATGTGATAAATAG TACG (SEQ ID NO: 1112) |
| bGRC_nm15 | 0.76 | 0.92 | 0.93 | 0.95 | 0.95 | 0.94 | 0.92 | 0.93 | CTCTCGGGAAGACAG GGCTGCTGTGTATCCT GATTGTGGTGGTGGAT ACG (SEQ ID NO: 1113) |
| bGRC_nm16 | 0.93 | 0.94 | 0.94 | 0.92 | 0.93 | 0.93 | 0.95 | 0.91 | GAGGGGACAGTCCTG GGTCCCCGCCAATCCG GCCCTTGAGGTTGAGC TCG (SEQ ID NO: 1114) |
| bGRC_nm17 | 0.92 | 0.92 | 0.92 | 0.93 | 0.92 | 0.93 | 0.90 | 0.93 | ATAGGTGAATTCTATA GCCAGGTGGCCTCCA GAAGCTTACGAAATG ATCG (SEQ ID NO: 1115) |
| bGRC_nm18 | 0.93 | 0.93 | 0.94 | 0.93 | 0.94 | 0.93 | 0.93 | 0.93 | CGCCCTGCGTTGCGTT CTCCACACAGCAGCC ACGGTGACTTTGTTAA AAT (SEQ ID NO: 1116) |

TABLE 4G-continued

Granolucytes and Subtypes Marker

| | | | | | | | | | |
|---|---|---|---|---|---|---|---|---|---|
| bGRC_nm19 | 0.89 | 0.91 | 0.89 | 0.88 | 0.91 | 0.87 | 0.90 | 0.88 | CGGAATATTCAAAAC CAGATGGACAGTTAG GTCGATAGATAAGAC AGATA (SEQ ID NO: 1117) |
| bGRC_nm20 | 0.84 | 0.95 | 0.96 | 0.95 | 0.97 | 0.95 | 0.94 | 0.94 | AGTGCGCTGCTGCGG GAGGAAGCCAGTGTC TTCCTGGAGACGGCTT CACG (SEQ ID NO: 1118) |
| bGRC_nm21 | 0.93 | 0.92 | 0.92 | 0.92 | 0.93 | 0.93 | 0.93 | 0.90 | CGCTTTGAGATTGAAG AGAACATACACTGGA CCATATAGGGGTCTTC TAC (SEQ ID NO: 1119) |
| bGRC_nm22 | 0.89 | 0.90 | 0.90 | 0.89 | 0.90 | 0.90 | 0.91 | 0.87 | CGGCTTCCTTTGATGG GAGACAGGAGGAGTA GAAATAAGCTGAGCT ACAC (SEQ ID NO: 1120) |
| bGRC_nm23 | 0.91 | 0.91 | 0.89 | 0.88 | 0.90 | 0.91 | 0.90 | 0.91 | ACTGAGCAGCAAGTA TTCCTTGTGTACCAGT CTCTGTTCCAGAAACA ACG (SEQ ID NO: 1121) |
| bGRC_nm24 | 0.90 | 0.90 | 0.91 | 0.91 | 0.94 | 0.91 | 0.93 | 0.91 | CGGAGAAATGCAAAT CTGATAATAAGCACAT ATATAGATGGCATTTA AAT (SEQ ID NO: 1122) |
| bGRC_nm25 | 0.88 | 0.89 | 0.87 | 0.89 | 0.89 | 0.87 | 0.86 | 0.89 | GCTTTATCTAACAATT TATTTAACAAACAGTT AACTAGCACTGTGTGC CG (SEQ ID NO: 1123) |
| bGRC_nm26 | 0.89 | 0.90 | 0.91 | 0.89 | 0.91 | 0.90 | 0.92 | 0.90 | CGGAACCCTGACTTTG GAGGCTTCAGACATCC TGAAATATAATTCAGA TA (SEQ ID NO: 1124) |
| bGRC_nm27 | 0.91 | 0.91 | 0.86 | 0.87 | 0.88 | 0.89 | 0.91 | 0.89 | CCTGGTCACAACATTC AGAGGACACACAGGT AGGATTAACAGTAAA ATCG (SEQ ID NO: 1125) |
| bGRC_nm28 | 0.88 | 0.89 | 0.91 | 0.89 | 0.90 | 0.89 | 0.92 | 0.87 | GCCAGGATCACAAAG TTTCTGCCTTATCATTT ATGGTTATTGTTACCT CG (SEQ ID NO: 1126) |
| bGRC_nm29 | 0.93 | 0.94 | 0.94 | 0.94 | 0.94 | 0.94 | 0.94 | 0.95 | AATAAGAAGAGTCCG TACCTCTTTCCCCTCA CTCTGCACCCAGAATA CCG (SEQ ID NO: 1127) |
| bGRC_nm30 | 0.90 | 0.92 | 0.91 | 0.91 | 0.92 | 0.91 | 0.91 | 0.89 | TTCAGCAGATGAGATC TCAGCAATCCCCACTA GGCTGGCTTCTAATAA CG (SEQ ID NO: 1128) |
| bGRC_nm31 | 0.95 | 0.95 | 0.94 | 0.93 | 0.94 | 0.96 | 0.96 | 0.95 | TGGCTTCTGCCAGAGA AGCCCCGGACAGCTG CGAGCGCTGGCTGAG AACG (SEQ ID NO: 1129) |
| bGRC_nm32 | 0.90 | 0.91 | 0.86 | 0.88 | 0.90 | 0.86 | 0.90 | 0.82 | GGCAGGTCTTCTGACT TGGTCTCATTTTCTGC ATGGCTTTCTCCCTCT CG (SEQ ID NO: 1130) |
| bGRC_nm33 | 0.90 | 0.90 | 0.89 | 0.90 | 0.92 | 0.93 | 0.90 | 0.91 | CGTGGCTTTTGATTAT CTGCAAAGATTAATG AGCCCTAATGAACGG GTCA (SEQ ID NO: 1131) |
| bGRC_nm34 | 0.91 | 0.92 | 0.88 | 0.88 | 0.90 | 0.90 | 0.92 | 0.90 | GTCCCACTGGGGCAC ACAGCAGAGCAATGA AATTCCTGCATATTAA GACG (SEQ ID NO: 1132) |
| bGRC_nm35 | 0.88 | 0.90 | 0.85 | 0.84 | 0.88 | 0.85 | 0.83 | 0.84 | CGGTAGACTGATGAA ATAAGGTTTGGTTCAT ATCCATAACAGTTGAC TAC (SEQ ID NO: 1133) |

TABLE 4G-continued

Granolucytes and Subtypes Marker

| | | | | | | | | | |
|---|---|---|---|---|---|---|---|---|---|
| bGRC_nm36 | 0.89 | 0.93 | 0.90 | 0.91 | 0.90 | 0.91 | 0.89 | 0.87 | CGGTAGGTGTGCACA AGCCAGAGCAGAGTC CCATTCCTTGCATCCG CCAC (SEQ ID NO: 1134) |
| bGRC_nm37 | 0.90 | 0.92 | 0.88 | 0.88 | 0.90 | 0.88 | 0.84 | 0.83 | CCTGGCACCTGCTTCA CAGCCTTCCCGCTTGC CTGCTTTGTGGTGAGT CG (SEQ ID NO: 1135) |
| bGRC_nm38 | 0.90 | 0.90 | 0.89 | 0.90 | 0.88 | 0.91 | 0.91 | 0.89 | CGGTCTGATCTGAACT CGGCTTCAGTTGGTCT GGAATGCACCGGCTG CAT (SEQ ID NO: 1136) |
| bGRC_nm39 | 0.91 | 0.91 | 0.90 | 0.86 | 0.90 | 0.90 | 0.91 | 0.91 | CGCTGAATCATGGAGT TTATCTTAAGGATGGA TCTGAATGAGATCTGA TA (SEQ ID NO: 1137) |
| bGRC_nm40 | 0.92 | 0.91 | 0.89 | 0.91 | 0.90 | 0.91 | 0.91 | 0.87 | AAATTCTGAATTTTCG CTACACTG TCCACAGT ACCAAATGGCAATAA CCG (SEQ ID NO: 1138) |
| bGRC_nm41 | 0.92 | 0.92 | 0.89 | 0.87 | 0.91 | 0.91 | 0.93 | 0.91 | CGGTGGCTGTTTCCAT AGTAGCCTCATATCAC TGCCAAATCTCATCTG AT (SEQ ID NO: 1139) |
| bGRC_nm42 | 0.79 | 0.89 | 0.86 | 0.85 | 0.87 | 0.87 | 0.86 | 0.88 | CTATCTGTGACAGATA ACCTATATCACAGATA GATCTATCTGTGACCT CG (SEQ ID NO: 1140) |
| bGRC_nm43 | 0.90 | 0.90 | 0.88 | 0.91 | 0.91 | 0.90 | 0.89 | 0.88 | CGCAATAAGCACAGA GCTGGACTTGAACCCA AGTTTTGCCACACAGG CCT (SEQ ID NO: 1141) |
| bGRC_nm44 | 0.89 | 0.89 | 0.90 | 0.89 | 0.89 | 0.89 | 0.90 | 0.90 | GGCTCTGTGGGTTTGG CTCTTAGAGTCAAGAT GGTCACCGCCTCCAAG CG (SEQ ID NO: 1142) |
| bGRC_nm45 | 0.92 | 0.93 | 0.91 | 0.93 | 0.93 | 0.94 | 0.94 | 0.93 | CACTAATTACCACTCA GTTCTTGGGCTGTAGC AAAGATAATTTCAATT CG (SEQ ID NO: 1143) |
| bGRC_nm46 | 0.88 | 0.88 | 0.85 | 0.74 | 0.85 | 0.84 | 0.89 | 0.86 | CGCAGTTATCTGTGGC TGATCATGGCTTGTCA TACTGCTACTCCTAGA TG (SEQ ID NO: 1144) |
| bGRC_nm47 | 0.90 | 0.91 | 0.82 | 0.83 | 0.86 | 0.85 | 0.89 | 0.85 | CGCTGGTGTGGGACC AGTCTCCTAGACCCAA GTGCTAGGAGTAGAA TGCT (SEQ ID NO: 1145) |
| bGRC_nm48 | 0.89 | 0.91 | 0.89 | 0.92 | 0.91 | 0.91 | 0.89 | 0.86 | GCATCCTAACAAATG AACAATCTTTAGCTAA AGACACTGACCAGAT TACG (SEQ ID NO: 1146) |
| bGRC_nm49 | 0.89 | 0.91 | 0.91 | 0.91 | 0.91 | 0.92 | 0.91 | 0.89 | CGTATGAGGTTATGTA GCATGTGAGGATAGG CATAGCTTTGTTACGT GTC (SEQ ID NO: 1147) |
| bGRC_nm50 | 0.87 | 0.87 | 0.87 | 0.88 | 0.88 | 0.88 | 0.90 | 0.91 | CGCTGATAAATCTCTT GAGTTTTTCAAGAAGG TGACAGTGTATACCAT GA (SEQ ID NO: 1148) |
| eGRC_nm2 | 0.97 | 0.97 | 0.97 | 0.96 | 0.97 | 0.97 | 0.97 | 0.98 | CGCGGTGACACCTAC AGCCACGCAAGCACC TGCGTAAACACGTGCT ACAG (SEQ ID NO: 1149) |
| eGRC_nm3 | 0.93 | 0.92 | 0.91 | 0.90 | 0.92 | 0.90 | 0.92 | 0.86 | CGGCAACCCCAAAGC ACCTGTTAAGACTCCT GACCCCCAAGTGGCA TGCA (SEQ ID NO: 1150) |
| eGRC_nm4 | 0.84 | 0.61 | 0.94 | 0.92 | 0.88 | 0.96 | 0.72 | 0.98 | CCATGGAGGAGCGTG ACGGAGAGATCTGCG TGTGACGCTGTGTGCT CTCG (SEQ ID NO: 1151) |

TABLE 4G-continued

| Granolucytes and Subtypes Marker | | | | | | | | | |
|---|---|---|---|---|---|---|---|---|---|
| eGRC_nm5 | 0.92 | 0.92 | 0.92 | 0.92 | 0.91 | 0.92 | 0.92 | 0.93 | CCCTATAATATCTTTA CTGTAAGGCAGCTACT TCTCCCTAAATAATTT CG (SEQ ID NO: 1152) |
| eGRC_nm6 | 0.74 | 0.91 | 0.90 | 0.88 | 0.89 | 0.90 | 0.88 | 0.90 | TAAAAAATTTCTTGCC ACATACGAGTTTAAAC CAAGATAATCACGGC ACG (SEQ ID NO: 1153) |
| eGRC_nm7 | 0.96 | 0.97 | 0.95 | 0.94 | 0.95 | 0.94 | 0.96 | 0.95 | CGCTATAGCAGTTTTT AAAAGCTTCTTCGATT GTTGACCGGTCCGTTA AG (SEQ ID NO: 1154) |
| eGRC_nm8 | 0.92 | 0.93 | 0.92 | 0.91 | 0.93 | 0.93 | 0.93 | 0.93 | CGGAAGCCAAGCTCT GTCCCAAGCACTGTGC TGATGATATCTCATTT CAT (SEQ ID NO: 1155) |
| eGRC_nm9 | 0.97 | 0.94 | 0.95 | 0.94 | 0.95 | 0.94 | 0.95 | 0.96 | CGCCGCTGCACCTCAT CCTCCATGCTGTCCAC CTGCCAGGATAAGGA GTG (SEQ ID NO: 1156) |
| eGRC_nm10 | 0.91 | 0.91 | 0.87 | 0.85 | 0.87 | 0.87 | 0.88 | 0.87 | CGTGGAAGAGGGACA GAATTTTAGAGAGAG AAACTCATTTGAGAA ATGGG (SEQ ID NO: 1157) |
| eGRC_nm11 | 0.89 | 0.91 | 0.89 | 0.90 | 0.91 | 0.89 | 0.91 | 0.89 | CGTCGTTATTCTTAGG AGATGCATGTTGAAAT ATTTAGAAATGATTTT AT (SEQ ID NO: 1158) |
| eGRC_nm12 | 0.87 | 0.89 | 0.84 | 0.88 | 0.89 | 0.87 | 0.88 | 0.84 | ACAGGGACCTAATTA ACTGACAGTTGGTCTG ATTGCCAAGCTGAGG GGCG (SEQ ID NO: 1159) |
| eGRC_nm13 | 0.94 | 0.94 | 0.94 | 0.93 | 0.92 | 0.93 | 0.93 | 0.93 | CGAAACACAGTCATTC ATGTTGGTAATTGTGA CAGAGATTATGTGGCC CA (SEQ ID NO: 1160) |
| eGRC_nm14 | 0.89 | 0.89 | 0.85 | 0.86 | 0.87 | 0.86 | 0.85 | 0.82 | AGATGGATAGTGGCTT CCTAATATCCCCTTTT CATCAGTGTTAAAAAT CG (SEQ ID NO: 1161) |
| eGRC_nm15 | 0.88 | 0.89 | 0.87 | 0.89 | 0.88 | 0.89 | 0.89 | 0.88 | TGAGGTTAAGAAATTT GCTCATGGCCATACAC GCAGCAAGCAGTTCT ACG (SEQ ID NO: 1162) |
| eGRC_nm16 | 0.90 | 0.93 | 0.87 | 0.86 | 0.89 | 0.89 | 0.91 | 0.87 | CGGTTGCTTAAGCTGA CACTGCAGAGCATTGC AAGAAGTGTTGATTA AAA (SEQ ID NO: 1163) |
| eGRC_nm17 | 0.85 | 0.90 | 0.90 | 0.88 | 0.88 | 0.88 | 0.90 | 0.91 | ATTTGTATTTTGACAG CCCATGGTAGCATCAG ATAAATTGCCTTTTAA CG (SEQ ID NO: 1164) |
| eGRC_nm18 | 0.89 | 0.89 | 0.85 | 0.86 | 0.87 | 0.87 | 0.88 | 0.85 | CGCACAACTGCTCCAT CTTTTAAGATATTGGA AGTGAGAGCACGGGA GGA (SEQ ID NO: 1165) |
| eGRC_nm19 | 0.86 | 0.89 | 0.86 | 0.86 | 0.87 | 0.87 | 0.88 | 0.87 | CTCCACAATAAGCTAA AGCCAACTCCTGCAAC AGGCTCCTGTGATCAA CG (SEQ ID NO: 1166) |
| eGRC_nm20 | 0.89 | 0.87 | 0.85 | 0.83 | 0.87 | 0.85 | 0.87 | 0.81 | CGGTGCCTGGGGCTCA GGTCTGTTCAAACTCC TGCTCACAGAAGCCTA CA (SEQ ID NO: 1167) |
| eGRC_nm21 | 0.89 | 0.91 | 0.87 | 0.85 | 0.89 | 0.88 | 0.88 | 0.85 | CGCAATCCTCAGAAG CTGACAGGAGCTTCA GAGAGGAGAATTACC TTACC (SEQ ID NO: 1168) |
| eGRC_nm22 | 0.85 | 0.91 | 0.91 | 0.92 | 0.92 | 0.93 | 0.93 | 0.91 | ATTTACACATCCAIAG GCCTCATTTCTGCTGT TCTAAAGAGTCTTTAT CG (SEQ ID NO: 1169) |

TABLE 4G-continued

Granolucytes and Subtypes Marker

| | | | | | | | | | |
|---|---|---|---|---|---|---|---|---|---|
| eGRC_nm23 | 0.87 | 0.87 | 0.85 | 0.85 | 0.86 | 0.86 | 0.86 | 0.84 | AACTCCTAAGGCCAA AGGAATGTGGTATGCT CACTGACTTGGCTTGG ACG (SEQ ID NO: 1170) |
| eGRC_nm24 | 0.79 | 0.84 | 0.82 | 0.81 | 0.81 | 0.81 | 0.83 | 0.79 | GGGGTAAATGGATGC AGAGCAGGCTTCTAA GGTGCAGTCCCCCTCC TTCG (SEQ ID NO: 1171) |
| eGRC_nm25 | 0.90 | 0.90 | 0.80 | 0.79 | 0.88 | 0.85 | 0.84 | 0.77 | CCAGGTGCAACATAT GCATGCCAGTTGGTGC ATGCAGCTTGTGAGGT CCG (SEQ ID NO: 1172) |
| eGRC_nm26 | 0.84 | 0.86 | 0.78 | 0.81 | 0.82 | 0.78 | 0.83 | 0.78 | CGGGCAGTCTGTGGTT CCTGACCAGACTGCTG GGGGTCAAATCTCTTT CA (SEQ ID NO: 1173) |
| eGRC_nm27 | 0.83 | 0.91 | 0.74 | 0.79 | 0.82 | 0.81 | 0.82 | 0.75 | GAATTTCCTAATATAT TTCTAACAGATAATGG TCACCACCACTACCCT CG (SEQ ID NO: 1174) |
| eGRC_nm28 | 0.86 | 0.88 | 0.78 | 0.75 | 0.77 | 0.77 | 0.81 | 0.67 | CGATTGTTAGGAAACC AAATGTTCTGAACATT ATTTTCATTAGAAAAG GG (SEQ ID NO: 1175) |
| eGRC_nm29 | 0.75 | 0.82 | 0.68 | 0.71 | 0.80 | 0.78 | 0.81 | 0.66 | AGCGGGAGGCTGGTG GCGTGCATCAGGCCAT GGGGGTGGGGCTTGG ACCG (SEQ ID NO: 1176) |
| eGRC_nm30 | 0.87 | 0.64 | 0.72 | 0.70 | 0.73 | 0.78 | 0.68 | 0.77 | CGACTGCTCAAACTGG GTTTGGAGAACAACC CAGTATGGCTTTTACA GAG (SEQ ID NO: 1177) |
| eGRC_nm31 | 0.98 | 0.96 | 0.98 | 0.98 | 0.98 | 0.98 | 0.98 | 0.98 | CGGGATAAAGCACAG CTCCTCCGCCAGCCCG GCGCGCAGCGGGCCT CACC (SEQ ID NO: 1178) |
| eGRC_nm32 | 0.98 | 0.98 | 0.99 | 0.99 | 0.99 | 0.99 | 0.99 | 0.98 | CGCACTCCGGTGACTC AGAATTGTCGCCGCTC CGTGCAAGTAAGTGTT TG (SEQ ID NO: 1179) |
| eGRC_nm33 | 0.98 | 0.99 | 0.96 | 0.99 | 0.98 | 0.98 | 0.99 | 0.96 | GGTGATGAACGAGAA TGAGCGCTATGACGC AGTCCAGCACTGCCGC TACG (SEQ ID NO: 1180) |
| eGRC_nm34 | 0.90 | 0.91 | 0.92 | 0.92 | 0.91 | 0.91 | 0.91 | 0.93 | AGTATCTAGAAAAAC CCAGAGAATGATATTC CACAAAACGGTAAGC ATCG (SEQ ID NO: 1181) |
| eGRC_nm35 | 0.94 | 0.92 | 0.93 | 0.93 | 0.92 | 0.94 | 0.95 | 0.92 | CGCGGGAGCTGCGGG CTGCGGTGATCCAGCT TCTGGACACCTCCTAT CTG (SEQ ID NO: 1182) |
| eGRC_nm36 | 0.91 | 0.90 | 0.87 | 0.85 | 0.87 | 0.86 | 0.89 | 0.84 | CGCCCTAGGGCCAAG AGTTGGGCCCCGTCTG AGCTTTTTTCAACTCT GTT (SEQ ID NO: 1183) |
| eGRC_nm37 | 0.93 | 0.93 | 0.92 | 0.93 | 0.93 | 0.93 | 0.93 | 0.92 | CCCAATAGAGGCTGTC TCAACAGTGGCCAAC AGAACTCTCATGAGTA TCG (SEQ ID NO: 1184) |
| eGRC_nm38 | 0.92 | 0.92 | 0.93 | 0.93 | 0.93 | 0.93 | 0.94 | 0.95 | GTAGACCTTGCTAATA ACTTGCCTATAAGTTC CACAATACTCCCACTA CG (SEQ ID NO: 1185) |
| eGRC_nm39 | 0.90 | 0.91 | 0.89 | 0.91 | 0.90 | 0.91 | 0.91 | 0.89 | CGCAGAGTCTTGACCA CAAGGAAAATCTTGTT TTTGAGCAATAACCCT TC (SEQ ID NO: 1186) |
| eGRC_nm40 | 0.83 | 0.90 | 0.84 | 0.89 | 0.84 | 0.86 | 0.85 | 0.80 | CGTCAAGCTTTGTTGA GTCAGACAGTGTCTGT CCAAACTACTCAAGTC AG (SEQ ID NO: 1187) |

TABLE 4G-continued

Granolucytes and Subtypes Marker

| | | | | | | | | | |
|---|---|---|---|---|---|---|---|---|---|
| eGRC_nm41 | 0.98 | 0.98 | 0.98 | 0.98 | 0.98 | 0.98 | 0.98 | 0.98 | GGGCGAAGTCGCTGG TGCCAGAGTCAATGA CACGGAGAGGAAACG CTTCG (SEQ ID NO: 1188) |
| eGRC_nm42 | 0.90 | 0.90 | 0.87 | 0.88 | 0.90 | 0.89 | 0.90 | 0.89 | TTTACTGATTTAG GAT GTCGACCATCTAGTCT GCCAGAGCTGCAATA ACG (SEQ ID NO: 1189) |
| eGRC_nm43 | 0.88 | 0.91 | 0.91 | 0.89 | 0.90 | 0.91 | 0.89 | 0.91 | CGGCAAGTCCTATTGA GATTATAACAATGAC ACTGATAAAAAGAA GATG (SEQ ID NO: 1190) |
| eGRC_nm44 | 0.92 | 0.91 | 0.91 | 0.92 | 0.92 | 0.89 | 0.92 | 0.93 | AGCACGTTCATGACCC TTGAAAGTCTTCGAAA ACAGATTACTGGGCTT CG (SEQ ID NO: 1191) |
| eGRC_nm45 | 0.93 | 0.92 | 0.89 | 0.87 | 0.92 | 0.90 | 0.89 | 0.87 | CGTGCACTCTGAACAA GCATTCATTTGGCTGC ACAGGGCCAGATCAA GGT (SEQ ID NO: 1192) |
| eGRC_nm46 | 0.92 | 0.93 | 0.90 | 0.92 | 0.92 | 0.91 | 0.91 | 0.88 | ACTAGCTTTGCGAAAG CCACAGGGAAGTGAT CTTGGTTGTGCAGGTG TCG (SEQ ID NO: 1193) |
| eGRC_nm47 | 0.93 | 0.91 | 0.93 | 0.91 | 0.93 | 0.94 | 0.93 | 0.94 | AAATGAATGTAGATA CCATCTTAGCCAGGTG ATGAAACAAACTGGT ATCG (SEQ ID NO: 1194) |
| eGRC_nm48 | 0.90 | 0.90 | 0.89 | 0.90 | 0.89 | 0.90 | 0.90 | 0.88 | CGGAAATCAGAGGGA GAAGACGCATATCTTG TTTCAGTGAGGGTGAT CCC (SEQ ID NO: 1195) |
| eGRC_nm49 | 0.88 | 0.91 | 0.91 | 0.90 | 0.91 | 0.92 | 0.91 | 0.91 | CGGTCAGAGGGGACC ATCTGTTTATCTTACA GGCTTAATATGATCAC AGG (SEQ ID NO: 1196) |
| eGRC_nm50 | 0.91 | 0.92 | 0.90 | 0.90 | 0.91 | 0.91 | 0.88 | 0.88 | TACCAGCCCTTCATTT CTTTGCTTTGACTCTTT AATTTCCAAGATAATC G (SEQ ID NO: 1197) |
| eGRC_nm51 | 0.91 | 0.92 | 0.91 | 0.93 | 0.92 | 0.92 | 0.93 | 0.92 | CGGAAGGCTGGGGAA ACAGGCTCTGCCCTAT ATCTGAGGGAAGTGT GCAT (SEQ ID NO: 1198) |
| nGRC_nm1 | 0.97 | 0.96 | 0.98 | 0.98 | 0.97 | 0.97 | 0.97 | 0.96 | CGCCAGGTTTCGAGAT GAAATCTCCGCCCTGT AGCTCCGGACGTCCTC CA (SEQ ID NO: 1199) |
| nGRC_nm3 | 0.97 | 0.95 | 0.97 | 0.96 | 0.96 | 0.95 | 0.97 | 0.97 | CGGCTAAGTCCCCACG TACGCCATTAAACAAC GGTCAAATGGTAACA TGT (SEQ ID NO: 1200) |
| nGRC_nm4 | 0.94 | 0.96 | 0.92 | 0.96 | 0.96 | 0.92 | 0.96 | 0.95 | CTGCCCTTGGTCAGCA CCGTGTAGGGCATGTG CTCACCCGCTG GAGAT CG (SEQ ID NO: 1201) |
| GRC_18nm | 0.92 | 0.91 | 0.91 | 0.93 | 0.94 | 0.92 | 0.93 | 0.94 | CGAAACAGATTGCATT TCCTAGAAGGCCCCCA GCGATGTGGATTGAA GCG (SEQ ID NO: 1202) |
| nGRC_nm7 | 0.95 | 0.94 | 0.93 | 0.93 | 0.96 | 0.94 | 0.94 | 0.93 | CGGCTTGAGCGCCAG CAGCCTGCACAGGTTC CATGAGCTGGAGAGC TGCG (SEQ ID NO: 1203) |
| nGRC_nm8 | 0.89 | 0.91 | 0.89 | 0.90 | 0.90 | 0.89 | 0.92 | 0.91 | CGGACTACGAGTACC AGCACTCCAATTTGTA TGCCATATCAGGTATG TGG (SEQ ID NO: 1204) |
| nGRC_nm9 | 0.95 | 0.95 | 0.93 | 0.94 | 0.95 | 0.93 | 0.95 | 0.88 | AATACCTGGCACGCC AGGGTGATGCAACTG GGAGCTTCTGCACGTT CGCG (SEQ ID NO: 1205) |

TABLE 4G-continued

Granulocytes and Subtypes Marker

| | | | | | | | | | |
|---|---|---|---|---|---|---|---|---|---|
| nGRC_nm10 | 0.97 | 0.96 | 0.98 | 0.97 | 0.97 | 0.97 | 0.98 | 0.98 | CAGCGCCCGTGTGATG ATGATGCTCACGCTCC GGTGTGACACAGACG GCG (SEQ ID NO: 1206) |
| nGRC_nm11 | 0.89 | 0.89 | 0.63 | 0.83 | 0.73 | 0.70 | 0.75 | 0.48 | CGGGAGGAGCTGGGT GGATACCTTTCTAACT TCCGAGGCTGGCTACT CCT (SEQ ID NO: 1207) |
| nGRC_nm12 | 0.91 | 0.93 | 0.95 | 0.93 | 0.91 | 0.89 | 0.93 | 0.94 | CCCTCTGCCCAGCGCG TCTGGGACGTGTGCCC AAGAGCTTATTGAGA ACG (SEQ ID NO: 1208) |
| nGRC_nm13 | 0.96 | 0.96 | 0.97 | 0.97 | 0.97 | 0.97 | 0.96 | 0.95 | TCAGGAAATTGCGAA GAAATTCTGCGGCGG GTGCAGGATGCCCAC CCTCG (SEQ ID NO: 1209) |
| nGRC_nm15 | 0.83 | 0.89 | 0.85 | 0.86 | 0.85 | 0.86 | 0.92 | 0.86 | CGTGGAGATGAACTA GAACAGGTATGAGGT TCTAGCAGAAGAAAC ATTTG (SEQ ID NO: 1210) |
| nGRC_nm16 | 0.96 | 0.97 | 0.97 | 0.97 | 0.97 | 0.97 | 0.97 | 0.97 | CGATATTAGAAAGGA GCTCAAGGTAGTACA CTTCACGTGCCCCGGT AACG (SEQ ID NO: 1211) |
| nGRC_nm17 | 0.97 | 0.96 | 0.95 | 0.96 | 0.96 | 0.95 | 0.88 | 0.92 | CGGCACTTTCAACCAA ACAGAGACACTCCGG CTCGTACACAACCAGC CGT (SEQ ID NO: 1212) |
| nGRC_nm20 | 0.92 | 0.88 | 0.75 | 0.79 | 0.84 | 0.87 | 0.91 | 0.90 | CGCAATCCAGTCACAC TTGTGAAAATGCTGAA GACGGTGGTTACGGA AGC (SEQ ID NO: 1213) |
| nGRC_nm22 | 0.88 | 0.90 | 0.85 | 0.88 | 0.89 | 0.84 | 0.89 | 0.88 | CGCTGAGCCAGAACA ATAGGACTTCTTCTGT AGTTGTGAAACTTGTC AGT (SEQ ID NO: 1214) |
| nGRC_nm24 | 0.87 | 0.85 | 0.83 | 0.82 | 0.85 | 0.87 | 0.86 | 0.83 | GTACCAACTGAATTCA ATTTAAAAACAAAGA TGTCAGACATGCATCT TCG (SEQ ID NO: 1215) |
| nGRC_nm25 | 0.86 | 0.87 | 0.89 | 0.89 | 0.88 | 0.92 | 0.90 | 0.89 | GTGTATGGATTCGGCA TGGAGCCCTCAGCTGG CGGCTCTGGGTGCTGA CG (SEQ ID NO: 1216) |
| nGRC_nm26 | 0.92 | 0.92 | 0.91 | 0.90 | 0.90 | 0.91 | 0.92 | 0.86 | CGCACTTCTGTGCGCT CACTATGAGAAGCTGT GTTTACTCGCTCCGTG CT (SEQ ID NO: 1217) |
| nGRC_nm28 | 0.96 | 0.93 | 0.96 | 0.95 | 0.96 | 0.95 | 0.96 | 0.94 | TCCCAGTCATTCTCGG GGTAAGTTCCGAAGTT GGAGGTGTCGCCTTCG CG (SEQ ID NO: 1218) |
| nGRC_nm29 | 0.94 | 0.91 | 0.91 | 0.91 | 0.89 | 0.92 | 0.95 | 0.91 | CGTCCTCCGTCTGCCG CCCACTAATCGTTCCC CATACAGACTTCCTGG CG (SEQ ID NO: 1219) |
| nGRC_nm30 | 0.92 | 0.92 | 0.81 | 0.83 | 0.86 | 0.86 | 0.90 | 0.77 | AGGTCACAGATGCAG ACGTTTGCTCGAAGTG GCTGCCGAGCTCAGA CCCG (SEQ ID NO: 1220) |
| nGRC_nm31 | 0.92 | 0.92 | 0.91 | 0.91 | 0.92 | 0.91 | 0.90 | 0.92 | GTGGAGGATCCAATTC TAAGACAGCTCATTCA TTCACATGGCTGTTAG CG (SEQ ID NO: 1221) |
| nGRC_nm32 | 0.92 | 0.92 | 0.92 | 0.90 | 0.92 | 0.93 | 0.92 | 0.91 | TTCTCAACACCAGTTT TCTGAGCAGGGTGAA TAACTCTGCTCATACC TCG (SEQ ID NO: 1222) |
| nGRC_nm33 | 0.87 | 0.91 | 0.83 | 0.88 | 0.86 | 0.87 | 0.87 | 0.78 | TCCTATTACTCCAGAC GAATCTGTTTCATGTG CTGAAGCTCTCCCCTT CG (SEQ ID NO: 1223) |

TABLE 4G-continued

| Granulocytes and Subtypes Marker | | | | | | | | | |
|---|---|---|---|---|---|---|---|---|---|
| nGRC_nm34 | 0.85 | 0.86 | 0.84 | 0.85 | 0.86 | 0.84 | 0.84 | 0.84 | AAAACCAAGTCTAGG ATTTTTCCATGGATGG TTTCTCAGCCGCTCTC ACG (SEQ ID NO: 1224) |
| nGRC_nm35 | 0.90 | 0.89 | 0.89 | 0.90 | 0.91 | 0.92 | 0.92 | 0.90 | GGCTGTGGTTCTCTGC TTGTGCCCACTTTGTG TTTGTAAATAGCGAGT CG (SEQ ID NO: 1225) |
| nGRC_nm36 | 0.84 | 0.90 | 0.91 | 0.91 | 0.92 | 0.91 | 0.91 | 0.91 | CGGGGGCTAGAGTTC ATAATTTCTGGTAATC GCTCAACCCTGTGATT ACG (SEQ ID NO: 1226) |
| nGRC_nm37 | 0.87 | 0.90 | 0.91 | 0.91 | 0.91 | 0.92 | 0.92 | 0.91 | CGCTTTGCTTAGAGAT CAACAGAGTGACATC CTAGGGTCTGAGCCTC AAC (SEQ ID NO: 1227) |
| nGRC_nm38 | 0.88 | 0.89 | 0.83 | 0.81 | 0.86 | 0.84 | 0.83 | 0.83 | CAAAAGCCTGTGAGG AGCTCCTGGAAGACA TTAAGTTCTCTACAGC AACG (SEQ ID NO: 1228) |
| nGRC_nm39 | 0.87 | 0.88 | 0.87 | 0.87 | 0.88 | 0.87 | 0.87 | 0.78 | CGCAGGAGTAAAATT GGGTAAAACAAGCAC ATGGGAACTGAGGCA ATCTC (SEQ ID NO: 1229) |
| nGRC_nm40 | 0.89 | 0.90 | 0.88 | 0.89 | 0.89 | 0.88 | 0.87 | 0.83 | CGGGTGCAACTGGCA CCAAGAACAACACCC ATGCCCAGGTGACAA CTGCG (SEQ ID NO: 1230) |
| nGRC_nm41 | 0.87 | 0.85 | 0.80 | 0.82 | 0.84 | 0.83 | 0.82 | 0.69 | CGTGTTCATAAATGAG TGCAGTGATATCAATT TAAGAACATCCATCAT GT (SEQ ID NO: 1231) |
| nGRC_nm42 | 0.89 | 0.90 | 0.90 | 0.89 | 0.90 | 0.88 | 0.88 | 0.88 | ATGTTTGTACACAGCT GCCTCCTTGACTGTAG TTGATTGGCCTCTGTG CG (SEQ ID NO: 1232) |
| nGRC_nm43 | 0.94 | 0.69 | 0.92 | 0.92 | 0.87 | 0.91 | 0.88 | 0.95 | GAGACGAGCGTCTCA GACTTGAGGAAATAC ACGCGTGGAAGACGT GCGCG (SEQ ID NO: 1233) |
| nGRC_nm44 | 0.94 | 0.95 | 0.90 | 0.92 | 0.92 | 0.94 | 0.94 | 0.92 | GTTCTTCTCCGTGACA GGATGTTCTTTTCCGT GACAGGAAGTTCCGT CCG (SEQ ID NO: 1234) |
| nGRC_nm45 | 0.95 | 0.94 | 0.93 | 0.92 | 0.94 | 0.93 | 0.94 | 0.91 | AAGTGGGATCCGCAA GATGATGGATGAGTTT GAGGTAGACCCCTTTC CCG (SEQ ID NO: 1235) |
| nGRC_nm46 | 0.90 | 0.90 | 0.88 | 0.88 | 0.88 | 0.87 | 0.91 | 0.84 | TGACGCTGTATTTCCT GAAACTGCTCAGCAA GATTTCCAGCTATCCA GCG (SEQ ID NO: 1236) |
| nGRC_nm47 | 0.85 | 0.90 | 0.90 | 0.89 | 0.87 | 0.89 | 0.87 | 0.90 | CGGTCAGTTCCTGTGA GGAGGAAACAATGAT ACTGCATTATAGACAT CGT (SEQ ID NO: 1237) |
| nGRC_nm48 | 0.88 | 0.88 | 0.87 | 0.89 | 0.87 | 0.88 | 0.86 | 0.86 | CGGGGAGGGACTAGA TCAGAAGAGATCAAG GGCTCTATTCAGGAAC GTTG (SEQ ID NO: 1238) |
| nGRC_nm49 | 0.98 | 0.98 | 0.97 | 0.97 | 0.98 | 0.97 | 0.98 | 0.97 | CGTGGGCATCACGTA AGCAGCACACTAGGA GGCCCAGGCGCAGGC AAAGA (SEQ ID NO: 1239) |
| nGRC_nm50 | 0.84 | 0.89 | 0.90 | 0.92 | 0.90 | 0.89 | 0.89 | 0.90 | CAAATCACTGTAGTTC AGACAAAACCTTCAT ACCATTTTATTATTTA ACG (SEQ ID NO: 1240) |

TABLE 4H

| | | | | T-Cell Marker | | | | | |
|---|---|---|---|---|---|---|---|---|---|
| Marker-ID | Target ID | SYMBOL | Accession | Basophil Granulo-cytes | Eosino-phil Granulo-cytes | Neutro-phil Granulo-cytes | Classical Mono-cytes | Non-clas-sical | NK clas-sical |
| OTL_nm18 | cg03388043 | CCDC57 | NM_198082 | 0.95 | 0.96 | 0.97 | 0.96 | 0.96 | 0.84 |
| OTL_nm19 | cg19163395 | HDAC5 | NM_001015053 | 0.97 | 0.95 | 0.97 | 0.92 | 0.91 | 0.94 |
| OTL_nm5 | cg24612198 | CD3E | NM_000733 | 0.92 | 0.95 | 0.93 | 0.94 | 0.93 | 0.89 |
| OTL_nm4 | cg07545925 | CD3G | NM_000073 | 0.90 | 0.89 | 0.90 | 0.92 | 0.89 | 0.87 |
| OTL_nm22 | cg24441810 | TMEM177 | NM_001105198 | 0.86 | 0.89 | 0.92 | 0.91 | 0.92 | 0.90 |
| OTL_nm23 | cg17311865 | — | — | 0.93 | 0.93 | 0.91 | 0.91 | 0.89 | 0.89 |
| OTL_nm24 | cg17615629 | HLA-E | NM_05516 | 0.90 | 0.88 | 0.93 | 0.94 | 0.92 | 0.74 |
| OTL_nm25 | cg08659421 | IL32 | NM_001012632 | 0.89 | 0.90 | 0.91 | 0.90 | 0.90 | 0.80 |
| OTL_nm26 | cg07930673 | — | — | 0.89 | 0.88 | 0.88 | 0.89 | 0.90 | 0.79 |
| OTL_nm27 | cg10111816 | CDR2 | NM_001802 | 0.82 | 0.75 | 0.84 | 0.85 | 0.86 | 0.84 |
| OTL_nm28 | cg25643644 | CD3D | NM_000732 | 0.88 | 0.89 | 0.89 | 0.91 | 0.88 | 0.57 |
| OTL_nm29 | cg07630255 | MPI | NM_002435 | 0.87 | 0.89 | 0.89 | 0.89 | 0.87 | 0.77 |
| OTL_nm30 | cg18222759 | — | — | 0.92 | 0.90 | 0.92 | 0.90 | 0.94 | 0.90 |
| OTL_nm31 | cg02772121 | TRIM15 | NM_033229 | 0.89 | 0.85 | 0.74 | 0.87 | 0.85 | 0.74 |
| OTL_nm32 | cg03274669 | — | — | 0.87 | 0.87 | 0.86 | 0.85 | 0.89 | 0.61 |
| OTL_nm33 | cg25276892 | TNRC6B | NM_001024843 | 0.76 | 0.58 | 0.87 | 0.89 | 0.91 | 0.85 |
| OTL_nm34 | cg09232358 | — | — | 0.88 | 0.89 | 0.89 | 0.85 | 0.86 | 0.85 |
| OTL_nm35 | cg24215459 | TNIP3 | NM_001128843 | 0.82 | 0.84 | 0.87 | 0.88 | 0.86 | 0.55 |
| OTL_nm36 | cg26137915 | — | — | 0.88 | 0.89 | 0.89 | 0.88 | 0.87 | 0.57 |
| OTL_nm37 | cg04403423 | ATPIAI | NM_001160233 | 0.86 | 0.89 | 0.89 | 0.90 | 0.89 | 0.81 |
| OTL_nm38 | cg20567280 | — | — | 0.81 | 0.84 | 0.85 | 0.83 | 0.81 | 0.76 |
| OTL_nm39 | cg27111890 | UBASH3A | NM_001001895 | 0.65 | 0.86 | 0.89 | 0.89 | 0.88 | 0.84 |
| OTL_nm40 | cg10505658 | CCDC57 | NM_198082 | 0.82 | 0.73 | 0.81 | 0.86 | 0.82 | 0.58 |
| OTL_nm41 | cg24961795 | PLCGI | NM_002660 | 0.86 | 0.86 | 0.85 | 0.84 | 0.82 | 0.83 |
| OTL_nm42 | cg00027570 | CD2 | NM_001767 | 0.79 | 0.84 | 0.86 | 0.88 | 0.84 | 0.81 |
| OTL_nm43 | cg23318020 | — | — | 0.81 | 0.85 | 0.85 | 0.86 | 0.85 | 0.51 |
| OTL_nm44 | cg14841483 | ACLS6 | NM_001009185 | 0.80 | 0.79 | 0.77 | 0.82 | 0.84 | 0.78 |
| OTL_nm45 | cg03002526 | HACE1 | NM_020771 | 0.85 | 0.86 | 0.89 | 0.85 | 0.85 | 0.78 |
| OTL_nm46 | cg17922695 | SEPT9 | NM_001113492 | 0.84 | 0.71 | 0.73 | 0.87 | 0.68 | 0.68 |
| OTL_nm47 | cg03040292 | — | — | 0.63 | 0.84 | 0.90 | 0.89 | 0.87 | 0.59 |
| OTL_nm48 | cg11753157 | BCL11B | NM_022898 | 0.71 | 0.76 | 0.80 | 0.79 | 0.75 | 0.87 |
| OTL_nm49 | cg07203767 | — | — | 0.81 | 0.84 | 0.85 | 0.86 | 0.83 | 0.66 |
| OTL_nm50 | cg15227911 | CHD3 | NM_001005271 | 0.70 | 0.72 | 0.82 | 0.77 | 0.72 | 0.78 |
| OTL_nm51 | cg01830053 | — | — | 0.77 | 0.61 | 0.71 | 0.78 | 0.79 | 0.73 |
| OTL_nm52 | cg26271776 | — | — | 0.79 | 0.83 | 0.81 | 0.81 | 0.77 | 0.79 |
| OTL_nm53 | cg16239536 | HMHAI | NM_012292 | 0.84 | 0.82 | 0.83 | 0.82 | 0.81 | 0.58 |
| OTL_nm54 | cg08445740 | FAM71B | NM_130899 | 0.79 | 0.84 | 0.85 | 0.84 | 0.81 | 0.56 |

TABLE 4H-continued

T-Cell Marker

| Marker-ID | Target ID | | | | | | | | |
|---|---|---|---|---|---|---|---|---|---|
| OTL_nm55 | cg27666046 | SECTM1 | NM_003004 | 0.70 | 0.73 | 0.73 | 0.76 | 0.72 | 0.57 |
| OTL_nm56 | cg26053876 | — | — | 0.81 | 0.83 | 0.79 | 0.77 | 0.72 | 0.68 |
| OTL_nm57 | cg06110802 | RPS3A | NM_001006 | 0.79 | 0.77 | 0.85 | 0.82 | 0.83 | 0.83 |
| OTL_nm58 | cg07555731 | OR5AU1 | NM_001004731 | 0.72 | 0.69 | 0.72 | 0.69 | 0.69 | 0.61 |
| OTL_nm59 | cg13827677 | SET | NM_003011 | 0.62 | 0.56 | 0.72 | 0.80 | 0.74 | 0.61 |
| OTL_nm60 | cg24033471 | CACNA1C | NM_001129844 | 0.66 | 0.68 | 0.71 | 0.71 | 0.66 | 0.52 |

| Marker-ID | Target ID | B-Cells | CD4+ Th naive | CD4+ Th1 | CD4+ Th2 | CD4+ Th Central Mem. | CD4+ Th Effect. Mem. | CD8+ Cytotoxic T-Cells | NK T-Cells | Discovery Fragment |
|---|---|---|---|---|---|---|---|---|---|---|
| OTL_nm18 | cg0338-8043 | 0.97 | 0.07 | 0.02 | 0.02 | 0.03 | 0.03 | 0.03 | 0.07 | GGCTTGCGTAGT CAAGGCTGCCCG CGTGCCACGTGT GGTGGACAGCA TCG (SEQ ID NO: 1241) |
| OTL_nm19 | cg1916-3395 | 0.86 | 0.18 | 0.02 | 0.02 | 0.03 | 0.02 | 0.18 | 0.05 | CGCGCCTAGCTG GCACTCCATTCA TTGCGGACACAG CCGAGCCCTCCG GG (SEQ ID NO: 1242) |
| OTL_nm5 | cg2461-2198 | 0.94 | 0.14 | 0.04 | 0.04 | 0.05 | 0.07 | 0.09 | 0.08 | AGTCATCTGTTT TGCTTTTTTTCC AGAAGTAGTAA GTCTGCTGGCCT CCG (SEQ ID NO: 1243) |
| OTL_nm4 | cg075-45925 | 0.88 | 0.08 | 0.04 | 0.04 | 0.04 | 0.05 | 0.04 | 0.06 | CGGAAAAACAA AAGGCATCTGCA CCTGCAGCCCTG CTGAGGCCCCTG CTG (SEQ ID NO: 1244) |
| OTL_nm22 | cg244-41810 | 0.82 | 0.07 | 0.05 | 0.05 | 0.04 | 0.04 | 0.05 | 0.10 | GCATGGGTTCTG ATGGGGGCCCTG CCATAGGCCGCC TGGTGACCCACG CG (SEQ ID NO: 1245) |
| OTL_nm23 | cg1731-1865 | 0.82 | 0.18 | 0.00 | 0.03 | 0.05 | 0.02 | 0.12 | 0.25 | CGCACATCTCAT CTAATGCCATGGT ATTCCTTATTTC GTGTCAGCCCTT CC (SEQ ID NO: 1246) |
| OTL_nm24 | cg1761-5629 | 0.77 | 0.08 | 0.04 | 0.05 | 0.02 | 0.04 | 0.03 | 0.08 | CGCACCCAGCCG CACCTACTCTTT TGTAAAGCACCT GTGACAATGAA GGA (SEQ ID NO: 1247) |
| OTL_nm25 | cg086-59421 | 0.83 | 0.16 | 0.06 | 0.05 | 0.04 | 0.06 | 0.06 | 0.07 | CAAGCCCCAGG GCTCCTTGAGGA AACAACAGGGG TGCCAGACGTGG CCCG (SEQ ID NO: 1248) |

TABLE 4H-continued

T-Cell Marker

| | | | | | | | | | | |
|---|---|---|---|---|---|---|---|---|---|---|
| OTL_nm26 | cg0793-0673 | 0.89 | 0.09 | 0.09 | 0.09 | 0.08 | 0.10 | 0.09 | 0.16 | CGGGGGAGGCT GCTGAGTGGTTT TGAAATTATACA GAGCTGGATTTG AC (SEQ ID NO: 1249) |
| OTL_nm27 | cg101-11816 | 0.83 | 0.08 | 0.04 | 0.05 | 0.04 | 0.07 | 0.05 | 0.06 | CTTCTGTCGTTT CAATTGGCATCT GGTGAACTATGC CTAACAGCTTAA CG (SEQ ID NO: 1250) |
| OTL_nm28 | cg2564-3644 | 0.90 | 0.10 | 0.06 | 0.07 | 0.08 | 0.09 | 0.06 | 0.08 | GGAGTTCATTGC TGGGTGTGACTG GAGAGGTCAGG CAGGAGCTCTCA TCG (SEQ ID NO: 1251) |
| OTL_nm29 | cg0763-0255 | 0.82 | 0.08 | 0.07 | 0.07 | 0.06 | 0.09 | 0.12 | 0.16 | AGATTTTCCCTA GCCCTGCAGCTG CCCTCCATGGAT GGACTTGTATCT CG (SEQ ID NO: 1252) |
| OTL_nm30 | cg1822-2759 | 0.81 | 0.19 | 0.11 | 0.10 | 0.11 | 0.10 | 0.16 | 0.17 | CTGCTGTTCAGG GAAATGGCTTCC TTTCAGATGTGT TTCTCATAGTCT CG (SEQ ID NO: 1253) |
| OTL_nm31 | cg027-72121 | 0.83 | 0.10 | 0.05 | 0.06 | 0.09 | 0.06 | 0.10 | 0.10 | GGCGGGACGCT GTTTCGACACTG CAGGTAGGGTGT AAGGATTGCTCA TCG (SEQ ID NO: 1254) |
| OTL_nm32 | cg032-74669 | 0.91 | 0.09 | 0.05 | 0.04 | 0.05 | 0.05 | 0.12 | 0.23 | TGCCTGAAATGA TACAGTAGIGTA TAAACCAAGTAT CTCTGCTTGCAT CG (SEQ ID NO: 1255) |
| OTL_nm33 | cg2527-6892 | 0.73 | 0.03 | 0.03 | 0.03 | 0.04 | 0.04 | 0.10 | 0.10 | CGGTTTGCATCT CCAGCCCCGCG GCTCACAGGCCG TGTAACTTCACT GC (SEQ ID NO: 1256) |
| OTL_nm34 | cg0923-2358 | 0.89 | 0.22 | 0.10 | 0.12 | 0.13 | 0.13 | 0.11 | 0.10 | CGGCCATATTCT GGCAGGGTCAG TGGCTCCAACTA ACATTTGTTTGG TAC (SEQ ID NO: 1257) |
| OTL_nm35 | cg2421-5459 | 0.63 | 0.09 | 0.04 | 0.05 | 0.05 | 0.06 | 0.04 | 0.05 | CGAAGAATTGTA TTTGCATGTCTG AAATGAAAGCC CAGAGAATAGG GTGG (SEQ ID NO: 1258) |
| OTL_nm36 | cg2613-7915 | 0.86 | 0.12 | 0.11 | 0.10 | 0.10 | 0.13 | 0.10 | 0.17 | TGGAAACCCCTT CAGCAGCGTATG GTGCTGGGGACC TTCTGGGGAGAT CG (SEQ ID NO: 1259) |

TABLE 4H-continued

| T-Cell Marker | | | | | | | | | | |
|---|---|---|---|---|---|---|---|---|---|---|
| OTL_nm37 | cg044-03423 | 0.64 | 0.08 | 0.13 | 0.09 | 0.08 | 0.15 | 0.11 | 0.22 | AAAGCATGCAG CGTGGAGGGCT GGTCCAGGTCAG GTGGCATCAAA GAGCG (SEQ ID NO: 1260) |
| OTL_nm38 | cg2056-7280 | 0.79 | 0.11 | 0.06 | 0.08 | 0.07 | 0.08 | 0.08 | 0.20 | CGGTACCCCAAA ATTTGGTGCTTT GACATGCTGAAC TAGAGAAGCAG CCG (SEQ ID NO: 1261) |
| OTL_nm39 | cg2711-1890 | 0.92 | 0.14 | 0.13 | 0.13 | 0.12 | 0.14 | 0.12 | 0.16 | CGCATTCTTGCT CCCGAATACTAG CCAAGTCCCTAC AGAGGCTGATCC CG (SEQ ID NO: 1262) |
| OTL_nm40 | cg1050-5658 | 0.83 | 0.11 | 0.05 | 0.05 | 0.04 | 0.06 | 0.08 | 0.11 | GCAGCCTCTGGG TGGGTGGCGGA GGCTGAGGCGA TGCTGTCCACCA CACG (SEQ ID NO: 1263) |
| OTL_nm41 | cg249-61795 | 0.77 | 0.16 | 0.09 | 0.08 | 0.10 | 0.11 | 0.11 | 0.15 | CGAGTCTGAACC TCTCAACTCAG AAAACACCAGA GAAAAAGTGT GGAG (SEQ ID NO: 1264) |
| OTL_nm42 | cg0002-7570 | 0.82 | 0.17 | 0.10 | 0.11 | 0.10 | 0.14 | 0.14 | 0.15 | CGGTGTTTCTGC ACTGTTGATCCT GCTCTCGTCTCT GGCTACCCCAC TG (SEQ ID NO: 1265) |
| OTL_nm43 | cg2331-8020 | 0.83 | 0.11 | 0.08 | 0.04 | 0.07 | 0.09 | 0.09 | 0.17 | CGCTGAAACTTA GCAGGCACTCA GTAAATATTTG CTAAGCAGTTAA AAC (SEQ ID NO: 1266) |
| OTL_nm44 | cg148-41483 | 0.84 | 0.11 | 0.09 | 0.08 | 0.07 | 0.11 | 0.13 | 0.20 | CGCCTGCAGAA AGTGATCTTTCC GAGACAGGACG ATGTGCTCATCT CCTT (SEQ ID NO: 1267) |
| OTL_nm45 | cg0300-2526 | 0.81 | 0.18 | 0.16 | 0.12 | 0.13 | 0.10 | 0.16 | 0.19 | AGTCAAAGTCA AATCATGGGTAG TTCCGTCACTA CAAAGTGAGC CACG (SEQ ID NO: 1268) |
| OTL_nm46 | cg1792-2695 | 0.68 | 0.08 | 0.03 | 0.04 | 0.03 | 0.06 | 0.04 | 0.13 | CGTCCTGAGTTC CCAGACGTCATA GGTGCTTGCTCA ACGAGTGTTTGA AT (SEQ ID NO: 1269) |
| OTL_nm47 | cg0304-0292 | 0.63 | 0.09 | 0.07 | 0.05 | 0.05 | 0.06 | 0.12 | 0.20 | CTACCAAAGCAC TGGAGCTCATAA CAAGCTGCCTGT CCTTGGCCACCT CG (SEQ ID NO: 1270) |

TABLE 4H-continued

T-Cell Marker

| | | | | | | | | | | |
|---|---|---|---|---|---|---|---|---|---|---|
| OTL_nm48 | cg1175-3157 | 0.70 | 0.08 | 0.08 | 0.05 | 0.05 | 0.07 | 0.09 | 0.23 | CCACTGGAGATA TACTCTACCCTG GGGAGTTAAGA TAATTGTGAGCA CCG (SEQ ID NO: 1271) |
| OTL_nm49 | cg0720-3767 | 0.84 | 0.15 | 0.12 | 0.13 | 0.12 | 0.15 | 0.13 | 0.14 | CGGGCTGGGGA GGTGTAAAGAC AAATCCCGGTGA CCCTGGCCCTAA AAAG (SEQ ID NO: 1272) |
| OTL_nm50 | cg152-27911 | 0.82 | 0.06 | 0.05 | 0.05 | 0.05 | 0.06 | 0.12 | 0.21 | CGCGCGTGCTTT TGAGAAGGCAT ATGCTGGGTGTG TCTGTCTGTGCC TAT (SEQ ID NO: 1273) |
| OTL_nm51 | cg0183-0053 | 0.72 | 0.04 | 0.02 | 0.02 | 0.03 | 0.04 | 0.10 | 0.24 | ACGCTAGTGCAG CACTTTTGAAAG TAAAAAGCACTT TGCAATAATTAA CG (SEQ ID NO: 1274) |
| OTL_nm52 | cg2627-1776 | 0.71 | 0.22 | 0.11 | 0.11 | 0.11 | 0.11 | 0.19 | 0.14 | CGTCGTCCTGGC TAGGATCTAGCA TCTCAGTGCAAA TGGGCTATGTA AG (SEQ ID NO: 1275) |
| OTL_nm53 | cg1623-9536 | 0.74 | 0.14 | 0.09 | 0.11 | 0.12 | 0.15 | 0.15 | 0.23 | AGCCCGGGGTG CAGGACTCAGA CAGAAACCTCA GGGAGGCGGGG CTGACG (SEQ ID NO: 1276) |
| OTL_nm54 | cg0844-5740 | 0.64 | 0.11 | 0.12 | 0.13 | 0.14 | 0.16 | 0.15 | 0.15 | CGGTGATTCAAG ACCTCCAAGAAT TCCTGTGGTTCC CAGTAAATCCCC AC (SEQ ID NO: 1277) |
| OTL_nm55 | cg2766-6046 | 0.60 | 0.14 | 0.03 | 0.03 | 0.03 | 0.04 | 0.07 | 0.11 | CGAGGACGCCTT? AGGGACGTTTTG GGGCTTAAAGCC ACTAAAGACGTT TC (SEQ ID NO: 1278) |
| OTL_nm56 | cg2605-3876 | 0.75 | 0.19 | 0.08 | 0.17 | 0.11 | 0.14 | 0.14 | 0.13 | CGCCCACACAGT TTGGAGTTAAAC AGATCTCAACAA ATGAACACAGTT AT (SEQ ID NO: 1279) |
| OTL_nm57 | cg0611-0802 | 0.66 | 0.18 | 0.21 | 0.20 | 0.22 | 0.21 | 0.15 | 0.23 | CTGGTTCATCTC AGGTGTTGTTGC TTTGTGAACATT CACTAAGCTCTA CG (SEQ ID NO: 1280) |
| OTL_nm58 | cg0755-5731 | 0.55 | 0.16 | 0.09 | 0.08 | 0.12 | 0.12 | 0.15 | 0.12 | TCTTCTTAGTGA GCATGCTCATAG CTAACCTTCTTT GAACTTCCTCAA CG (SEQ ID NO: 1281) |

TABLE 4H-continued

T-Cell Marker

| | | | | | | | | | |
|---|---|---|---|---|---|---|---|---|---|
| OTL_nm59 | cg138-27677 | 0.72 | 0.12 | 0.16 | 0.15 | 0.13 | 0.18 | 0.13 | 0.21 | CTATCGCTTGGG GCTGTTGTGAGG CCTCGGTGAGAT AACCGTGCCATG CG (SEQ ID NO: 1282) |
| OTL_nm60 | cg240-33471 | 0.56 | 0.15 | 0.10 | 0.13 | 0.13 | 0.17 | 0.12 | 0.13 | TCTCTCCTTTGC TATGGGAGGGCT TGAATCTGTGGC AGCCTTCAAAAC CG (SEQ ID NO: 1283) |

TABLE 4I

MDSC (myeloid-derived suppressor cells) Marker

| Marker ID | Target ID | SYMBOL | Accession | Basophil Granulocytes | Eosinophil Granulocytes | Neutrophil Granulocytes | Classical Monocytes | Non-classical Monocytes |
|---|---|---|---|---|---|---|---|---|
| MDSC_nm1 | cg1031-7717 | UPP1 | NM_00-1287426 | 0.97 | 0.95 | 0.95 | 0.95 | 0.93 |
| MDSC_nm2 | cg0936-5002 | DAX | NM_0011-41969 | 0.96 | 0.96 | 0.92 | 0.88 | 0.90 |
| MDSC_nm3 | cg2249-6559 | M4SF19 | NM_001-204897 | 0.94 | 0.95 | 0.95 | 0.92 | 0.80 |
| MDSC_nm4 | cg2495-6391 | SRC | NM_00-5417 | 0.79 | 0.82 | 0.87 | 0.77 | 0.54 |
| MDSC_nm5 | cg2278-8953 | TYH3 | NM_02-5250 | 0.91 | 0.84 | 0.89 | 0.83 | 0.84 |
| MDSC_nm6 | cg0648-9615 | CLCN7 | NM_00-1114331 | 0.91 | 0.88 | 0.87 | 0.85 | 0.77 |
| MDSC_nm7 | cg189-95788 | — | — | 0.93 | 0.90 | 0.92 | 0.65 | 0.63 |
| MDSC_nm8 | cg1315-2501 | SMURF1 | NM_00-1199847 | 0.91 | 0.91 | 0.91 | 0.81 | 0.81 |
| MDSC_nm9 | cg1812-9996 | — | — | 0.88 | 0.89 | 0.90 | 0.90 | 0.90 |
| MDSC_nm10 | cg2070-0740 | — | — | 0.97 | 0.81 | 0.02 | 0.51 | 0.59 |
| MDSC_nm11 | cg023-41139 | ZC3H8 | NM_03-2494 | 0.90 | 0.91 | 0.92 | 0.87 | 0.88 |
| MDSC_nm12 | cg1998-4911 | SYNPO | NM_0011-09974 | 0.84 | 0.90 | 0.82 | 0.72 | 0.76 |
| MDSC_nm13 | cg221-37471 | ATP6V1E2 | NM_08-0653 | 0.90 | 0.87 | 0.90 | 0.87 | 0.84 |
| MDSC_nm14 | cg0882-2891 | SNX29 | NM_03-2167 | 0.84 | 0.77 | 0.51 | 0.72 | 0.76 |
| MDSC_nm15 | cg0047-6608 | ATN1 | NM_0010-07026 | 0.89 | 0.85 | 0.38 | 0.55 | 0.56 |
| MDSC_nm16 | cg2027-8790 | CTSZ | NM_00-1336 | 0.89 | 0.89 | 0.90 | 0.72 | 0.56 |
| MDSC_nm17 | cg0869-7732 | — | — | 0.91 | 0.91 | 0.92 | 0.79 | 0.62 |

TABLE 4I-continued

| MDSC (myeloid-derived suppressor cells) Marker | | | | | | | | |
|---|---|---|---|---|---|---|---|---|
| MDSC_nm18 | cg008-64293 | CMIP | NM_03-0629 | 0.87 | 0.82 | 0.82 | 0.87 | 0.87 |
| MDSC_nm19 | cg1444-4376 | GPNMB | NM_0010-05340 | 0.87 | 0.90 | 0.91 | 0.73 | 0.59 |
| MDSC_nm20 | cg0094-5409 | — | — | 0.88 | 0.88 | 0.88 | 0.88 | 0.87 |
| MDSC_nm21 | cg0336-6992 | PDXK | NM_00-3681 | 0.86 | 0.81 | 0.65 | 0.76 | 0.75 |
| MDSC_nm22 | cg0417-3586 | DOT1L | NM_03-2482 | 0.72 | 0.08 | 0.21 | 0.73 | 0.38 |
| MDSC_nm23 | cg0042-6089 | — | — | 0.85 | 0.89 | 0.87 | 0.87 | 0.82 |
| MDSC_nm24 | cg1086-4200 | CGF3 | NM_00-6315 | 0.34 | 0.47 | 0.60 | 0.58 | 0.65 |
| MDSC_nm25 | cg0425-2044 | — | — | 0.85 | 0.83 | 0.82 | 0.63 | 0.40 |
| MDSC_nm26 | cg0190-5967 | — | — | 0.84 | 0.85 | 0.85 | 0.83 | 0.82 |
| MDSC_nm27 | cg035-00164 | — | — | 0.90 | 0.89 | 0.86 | 0.66 | 0.71 |
| MDSC_nm28 | cg0173-4240 | NANOG | NM_02-4865 | 0.90 | 0.90 | 0.88 | 0.57 | 0.58 |
| MDSC_nm29 | cg0912-7592 | TRIM | NM_17-1982 | 0.77 | 0.76 | 0.70 | 0.81 | 0.79 |
| MDSC_nm30 | CG090-88625 | CCR1 | NM_00-1295 | 0.82 | 0.87 | 0.89 | 0.87 | 0.83 |
| MDSC_nm31 | cg1769-9214 | APBB2 | NM_0011-66050 | 0.88 | 0.89 | 0.86 | 0.82 | 0.76 |
| MDSC_nm32 | cg0793-7803 | MFSD12 | NM_0010-42680 | 0.71 | 0.51 | 0.90 | 0.90 | 0.85 |
| MDSC_nm33 | cg2728-2397 | HS1BP3 | NM_02-2460 | 0.81 | 0.85 | 0.85 | 0.68 | 0.46 |
| MDSC_nm34 | cg0135-9676 | RXRB | NM_0012-70401 | 0.84 | 0.87 | 0.86 | 0.88 | 0.87 |
| MDSC_nm35 | cg054-76182 | PHF15 | NM_01-5288 | 0.75 | 0.78 | 0.76 | 0.66 | 0.63 |
| MDSC_nm36 | cg1481-2474 | SORCS2 | NM_02-0777 | 0.80 | 0.83 | 0.85 | 0.82 | 0.74 |
| MDSC_nm37 | cg0821-0681 | — | — | 0.89 | 0.89 | 0.91 | 0.66 | 0.45 |
| MDSC_nm38 | cg1707-4014 | ITGAE | NM_00-2208 | 0.96 | 0.67 | 0.03 | 0.42 | 0.49 |
| MDSC_nm39 | cg1532-0001 | MRAS | NM_0010-85049 | 0.84 | 0.85 | 0.81 | 0.56 | 0.48 |
| MDSC_nm40 | cg1939-9285 | — | — | 0.85 | 0.86 | 0.86 | 0.83 | 0.86 |
| MDSC_nm41 | cg2116-4050 | — | — | 0.81 | 0.85 | 0.85 | 0.77 | 0.78 |
| MDSC_nm42 | cg2120-4530 | RGIC1 | NM_00-1031711 | 0.79 | 0.84 | 0.82 | 0.86 | 0.88 |
| MDSC_nm43 | cg072-60017 | CSF1R | NM_00-1288705 | 0.80 | 0.87 | 0.86 | 0.83 | 0.62 |

TABLE 4I-continued

| MDSC (myeloid-derived suppressor cells) Marker | | | | | | | | |
|---|---|---|---|---|---|---|---|---|
| MDSC_nm44 | cg06193597 | AC-104809.3 | — | 0.87 | 0.82 | 0.81 | 0.87 | 0.86 |
| MDSC_nm45 | cg26174398 | — | — | 0.73 | 0.67 | 0.79 | 0.72 | 0.51 |
| MDSC_nm46 | cg24587185 | SH3RF3 | NM_001-099289 | 0.83 | 0.84 | 0.85 | 0.81 | 0.72 |
| MDSC_nm47 | cg05827190 | MFSD7 | NM_03-2219 | 0.89 | 0.79 | 0.63 | 0.60 | 0.39 |
| MDSC_nm48 | cg03176993 | — | — | 0.80 | 0.79 | 0.73 | 0.58 | 0.42 |
| MDSC_nm49 | cg03372334 | MBN1.2 | NM_14-4778 | 0.72 | 0.68 | 0.69 | 0.70 | 0.69 |
| MDSC_nm50 | cg21877464 | SPARC | NM_00-3118 | 0.80 | 0.73 | 0.32 | 0.48 | 0.44 |
| MDSC_nm51 | cg09854726 | FKBP2 | NM_0011-35208 | 0.90 | 0.72 | 0.82 | 0.71 | 0.36 |
| MDSC_nm52 | cg16490209 | BCAT1 | NM_00117-8091 | 0.86 | 0.80 | 0.73 | 0.61 | 0.51 |
| MDSC_nm53 | cg181-14313 | — | — | 0.80 | 0.75 | 0.64 | 0.52 | 0.44 |
| MDSC_nm54 | cg223-07974 | — | — | 0.64 | 0.43 | 0.50 | 0.49 | 0.41 |
| MDSC_nm55 | cg191-32462 | AMPD3 | NM_00-0480 | 0.63 | 0.06 | 0.07 | 0.44 | 0.37 |
| MDSC_nm56 | cg1222-9979 | MYO9B | NM_00-1130065 | 0.68 | 0.39 | 0.76 | 0.63 | 0.53 |
| MDSC_nm57 | cg06093152 | — | — | 0.82 | 0.53 | 0.47 | 0.48 | 0.33 |

| Marker ID | Target ID | NK classical | NK bright NKB_1 | NKB_2 | NK bright | B-Cells | MDSC | CD4+ Th naive | CD4+ act. | CD4+ Th1 | CD4+ Th2 | CD4+ Th Central Mem. |
|---|---|---|---|---|---|---|---|---|---|---|---|---|
| MDSC_nm1 | cg10317717 | 0.95 | 0.96 | 0.93 | 0.94 | 0.97 | 0.15 | 0.95 | 0.92 | 0.93 | 0.95 | 0.96 |
| MDSC_nm2 | cg09365002 | 0.96 | 0.96 | 0.95 | 0.95 | 0.96 | 0.21 | 0.96 | 0.95 | 0.96 | 0.97 | 0.97 |
| MDSC_nm3 | cg22496559 | 0.76 | 0.91 | 0.86 | 0.88 | 0.82 | 0.28 | 0.93 | 0.91 | 0.93 | 0.94 | 0.93 |
| MDSC_nm4 | cg24956391 | 0.93 | 0.91 | 0.78 | 0.85 | 0.56 | 0.10 | 0.94 | 0.75 | 0.82 | 0.82 | 0.85 |
| MDSC_nm5 | cg22788953 | 0.95 | 0.89 | 0.88 | 0.89 | 0.94 | 0.29 | 0.94 | 0.90 | 0.92 | 0.92 | 0.94 |
| MDSC_nm6 | cg06489615 | 0.92 | 0.91 | 0.93 | 0.92 | 0.93 | 0.35 | 0.93 | 0.92 | 0.92 | 0.92 | 0.92 |
| MDSC_nm7 | cg189-95788 | 0.95 | 0.95 | 0.97 | 0.96 | 0.98 | 0.21 | 0.98 | 0.87 | 0.90 | 0.92 | 0.95 |
| MDSC_nm8 | cg1315-2501 | 0.91 | 0.92 | 0.89 | 0.91 | 0.92 | 0.36 | 0.91 | 0.90 | 0.91 | 0.90 | 0.91 |
| MDSC_nm9 | cg18129996 | 0.89 | 0.89 | 0.89 | 0.89 | 0.91 | 0.37 | 0.92 | 0.90 | 0.89 | 0.89 | 0.91 |
| MDSC_nm10 | cg20700740 | 0.98 | 0.98 | 0.95 | 0.96 | 0.98 | 0.17 | 0.84 | 0.97 | 0.98 | 0.98 | 0.97 |

TABLE 4I-continued

| MDSC (myeloid-derived suppressor cells) Marker | | | | | | | | | | | | |
|---|---|---|---|---|---|---|---|---|---|---|---|
| MDSC_nm11 | cg023-41139 | 0.90 | 0.90 | 0.84 | 0.87 | 0.90 | 0.28 | 0.92 | 0.88 | 0.86 | 0.88 | 0.90 |
| MDSC_nm12 | cg1998-4911 | 0.89 | 0.92 | 0.89 | 0.90 | 0.91 | 0.29 | 0.92 | 0.89 | 0.90 | 0.89 | 0.91 |
| MDSC_nm13 | cg221-37471 | 0.87 | 0.89 | 0.89 | 0.89 | 0.87 | 0.19 | 0.88 | 0.89 | 0.88 | 0.88 | 0.88 |
| MDSC_nm14 | cg0882-2891 | 0.90 | 0.89 | 0.90 | 0.90 | 0.91 | 0.27 | 0.91 | 0.90 | 0.86 | 0.89 | 0.87 |
| MDSC_nm15 | cg0047-6608 | 0.92 | 0.90 | 0.92 | 0.91 | 0.88 | 0.25 | 0.91 | 0.86 | 0.89 | 0.89 | 0.90 |
| MDSC_nm16 | cg2027-8790 | 0.89 | 0.86 | 0.83 | 0.84 | 0.47 | 0.33 | 0.90 | 0.86 | 0.87 | 0.89 | 0.89 |
| MDSC_nm17 | cg0869-7732 | 0.88 | 0.89 | 0.88 | 0.89 | 0.83 | 0.23 | 0.91 | 0.82 | 0.85 | 0.87 | 0.85 |
| MDSC_nm18 | cg008-64293 | 0.89 | 0.90 | 0.88 | 0.89 | 0.91 | 0.28 | 0.92 | 0.73 | 0.73 | 0.77 | 0.78 |
| MDSC_nm19 | cg1444-4376 | 0.87 | 0.83 | 0.81 | 0.82 | 0.84 | 0.22 | 0.93 | 0.81 | 0.87 | 0.88 | 0.88 |
| MDSC_nm20 | cg0094-5409 | 0.87 | 0.89 | 0.81 | 0.85 | 0.86 | 0.18 | 0.88 | 0.80 | 0.81 | 0.84 | 0.84 |
| MDSC_nm21 | cg0336-6992 | 0.86 | 0.83 | 0.87 | 0.85 | 0.89 | 0.25 | 0.88 | 0.81 | 0.84 | 0.83 | 0.83 |
| MDSC_nm22 | cg0417-3586 | 0.90 | 0.96 | 0.95 | 0.95 | 0.78 | 0.21 | 0.98 | 0.92 | 0.96 | 0.96 | 0.96 |
| MDSC_nm23 | cg0042-6089 | 0.85 | 0.79 | 0.75 | 0.77 | 0.62 | 0.33 | 0.89 | 0.81 | 0.84 | 0.85 | 0.86 |
| MDSC_nm24 | cg1086-4200 | 0.88 | 0.88 | 0.86 | 0.87 | 0.87 | 0.33 | 0.92 | 0.89 | 0.93 | 0.93 | 0.93 |
| MDSC_nm25 | cg0425-2044 | 0.87 | 0.90 | 0.89 | 0.90 | 0.88 | 0.17 | 0.89 | 0.80 | 0.85 | 0.87 | 0.85 |
| MDSC_nm26 | cg0190-5967 | 0.87 | 0.88 | 0.87 | 0.87 | 0.85 | 0.33 | 0.91 | 0.86 | 0.87 | 0.89 | 0.84 |
| MDSC_nm27 | cg035-00164 | 0.84 | 0.74 | 0.80 | 0.77 | 0.87 | 0.23 | 0.91 | 0.75 | 0.86 | 0.89 | 0.91 |
| MDSC_nm28 | cg0173-4240 | 0.87 | 0.81 | 0.74 | 0.78 | 0.87 | 0.26 | 0.90 | 0.79 | 0.83 | 0.84 | 0.84 |
| MDSC_nm29 | cg0912-7592 | 0.83 | 0.86 | 0.79 | 0.82 | 0.92 | 0.28 | 0.91 | 0.82 | 0.88 | 0.88 | 0.88 |
| MDSC_nm30 | CG090-88625 | 0.81 | 0.64 | 0.74 | 0.69 | 0.85 | 0.28 | 0.88 | 0.83 | 0.86 | 0.85 | 0.86 |
| MDSC_nm31 | cg1769-9214 | 0.89 | 0.88 | 0.87 | 0.88 | 0.90 | 0.16 | 0.91 | 0.70 | 0.76 | 0.77 | 0.74 |
| MDSC_nm32 | cg0793-7803 | 0.90 | 0.88 | 0.89 | 0.88 | 0.84 | 0.21 | 0.91 | 0.76 | 0.76 | 0.79 | 0.83 |
| MDSC_nm33 | cg2728-2397 | 0.84 | 0.81 | 0.88 | 0.84 | 0.81 | 0.25 | 0.85 | 0.81 | 0.82 | 0.83 | 0.82 |
| MDSC_nm34 | cg0135-9676 | 0.85 | 0.83 | 0.84 | 0.83 | 0.82 | 0.25 | 0.86 | 0.70 | 0.75 | 0.74 | 0.75 |
| MDSC_nm35 | cg054-76182 | 0.84 | 0.85 | 0.82 | 0.84 | 0.85 | 0.26 | 0.88 | 0.80 | 0.81 | 0.82 | 0.81 |
| MDSC_nm36 | cg1481-2474 | 0.83 | 0.75 | 0.71 | 0.73 | 0.83 | 0.24 | 0.87 | 0.75 | 0.79 | 0.79 | 0.78 |

TABLE 4I-continued

MDSC (myeloid-derived suppressor cells) Marker

| Marker ID | Target ID | | | | | | | | | | |
|---|---|---|---|---|---|---|---|---|---|---|---|
| MDSC_nm37 | cg0821-0681 | 0.85 | 0.82 | 0.82 | 0.82 | 0.83 | 0.13 | 0.88 | 0.73 | 0.82 | 0.83 | 0.85 |
| MDSC_nm38 | cg1707-4014 | 0.84 | 0.89 | 0.89 | 0.89 | 0.98 | 0.19 | 0.93 | 0.68 | 0.93 | 0.92 | 0.92 |
| MDSC_nm39 | cg1532-0001 | 0.81 | 0.81 | 0.81 | 0.81 | 0.81 | 0.28 | 0.87 | 0.84 | 0.80 | 0.82 | 0.83 |
| MDSC_nm40 | cg1939-9285 | 0.86 | 0.88 | 0.85 | 0.86 | 0.83 | 0.28 | 0.88 | 0.66 | 0.76 | 0.69 | 0.77 |
| MDSC_nm41 | cg2116-4050 | 0.83 | 0.84 | 0.85 | 0.85 | 0.82 | 0.25 | 0.91 | 0.73 | 0.69 | 0.80 | 0.82 |
| MDSC_nm42 | cg2120-4530 | 0.78 | 0.85 | 0.85 | 0.85 | 0.85 | 0.21 | 0.85 | 0.67 | 0.63 | 0.68 | 0.71 |
| MDSC_nm43 | cg072-60017 | 0.77 | 0.83 | 0.84 | 0.83 | 0.82 | 0.22 | 0.88 | 0.63 | 0.67 | 0.66 | 0.67 |
| MDSC_nm44 | cg0619-3597 | 0.84 | 0.90 | 0.92 | 0.91 | 0.55 | 0.16 | 0.78 | 0.42 | 0.62 | 0.65 | 0.45 |
| MDSC_nm45 | cg2617-4398 | 0.79 | 0.83 | 0.84 | 0.84 | 0.70 | 0.14 | 0.84 | 0.61 | 0.65 | 0.57 | 0.64 |
| MDSC_nm46 | cg2458-7185 | 0.70 | 0.75 | 0.73 | 0.74 | 0.83 | 0.19 | 0.84 | 0.57 | 0.54 | 0.64 | 0.66 |
| MDSC_nm47 | cg0582-7190 | 0.88 | 0.91 | 0.87 | 0.89 | 0.83 | 0.25 | 0.90 | 0.71 | 0.77 | 0.77 | 0.79 |
| MDSC_nm48 | cg0317-6993 | 0.83 | 0.84 | 0.79 | 0.81 | 0.81 | 0.18 | 0.88 | 0.78 | 0.75 | 0.82 | 0.81 |
| MDSC_nm49 | cg0337-2334 | 0.83 | 0.79 | 0.80 | 0.79 | 0.76 | 0.19 | 0.70 | 0.88 | 0.80 | 0.80 | 0.74 |
| MDSC_nm50 | cg2187-7464 | 0.83 | 0.84 | 0.83 | 0.83 | 0.84 | 0.20 | 0.86 | 0.74 | 0.75 | 0.78 | 0.79 |
| MDSC_nm51 | cg0985-4726 | 0.88 | 0.88 | 0.82 | 0.85 | 0.55 | 0.19 | 0.91 | 0.68 | 0.71 | 0.75 | 0.78 |
| MDSC_nm52 | cg1649-0209 | 0.77 | 0.86 | 0.80 | 0.83 | 0.87 | 0.21 | 0.87 | 0.74 | 0.61 | 0.80 | 0.77 |
| MDSC_nm53 | cg181-14313 | 0.83 | 0.83 | 0.84 | 0.84 | 0.35 | 0.21 | 0.88 | 0.70 | 0.64 | 0.77 | 0.72 |
| MDSC_nm54 | cg223-07974 | 0.74 | 0.69 | 0.69 | 0.69 | 0.69 | 0.17 | 0.81 | 0.71 | 0.76 | 0.81 | 0.77 |
| MDSC_nm55 | cg191-32462 | 0.84 | 0.87 | 0.81 | 0.84 | 0.51 | 0.15 | 0.73 | 0.82 | 0.76 | 0.81 | 0.77 |
| MDSC_nm56 | cg1222-9979 | 0.63 | 0.76 | 0.66 | 0.71 | 0.71 | 0.15 | 0.88 | 0.74 | 0.77 | 0.73 | 0.72 |
| MDSC_nm57 | cg0609-3152 | 0.78 | 0.85 | 0.83 | 0.84 | 0.75 | 0.14 | 0.90 | 0.59 | 0.59 | 0.69 | 0.68 |

| Marker ID | Target ID | CD4+ Th Effect. Mem. | CD4+ NKT cells | CD4+ TFH | CD8+ Cytotoxic T-Cells | CD8+ naive T8n_1 | CD8+ act. | CD8+ Th Central Mem. | CD8+ Th Effect Mem. | TEMRA |
|---|---|---|---|---|---|---|---|---|---|---|
| MDSC_nm1 | cg1031-7717 | 0.95 | 0.83 | 0.90 | 0.96 | 0.94 | 0.95 | 0.94 | 0.95 | 0.94 |
| MDSC_nm2 | cg0936-5002 | 0.96 | 0.92 | 0.94 | 0.97 | 0.96 | 0.95 | 0.96 | 0.96 | 0.96 |
| MDSC_nm3 | cg2249-6559 | 0.94 | 0.79 | 0.91 | 0.87 | 0.93 | 0.92 | 0.82 | 0.88 | 0.60 |

TABLE 4I-continued

MDSC (myeloid-derived suppressor cells) Marker

| | | | | | | | | | | |
|---|---|---|---|---|---|---|---|---|---|---|
| MDSC_nm4 | cg2495-6391 | 0.84 | 0.80 | 0.62 | 0.93 | 0.91 | 0.83 | 0.88 | 0.87 | 0.91 |
| MDSC_nm5 | cg2278-8953 | 0.95 | 0.88 | 0.90 | 0.95 | 0.94 | 0.91 | 0.88 | 0.93 | 0.95 |
| MDSC_nm6 | cg0648-9615 | 0.92 | 0.91 | 0.91 | 0.93 | 0.90 | 0.92 | 0.90 | 0.91 | 0.90 |
| MDSC_nm7 | cg189-95788 | 0.95 | 0.88 | 0.91 | 0.95 | 0.96 | 0.83 | 0.92 | 0.88 | 0.87 |
| MDSC_nm8 | cg1315-2501 | 0.91 | 0.90 | 0.88 | 0.92 | 0.91 | 0.90 | 0.91 | 0.91 | 0.90 |
| MDSC_nm9 | cg1812-9996 | 0.90 | 0.90 | 0.90 | 0.91 | 0.88 | 0.90 | 0.87 | 0.88 | 0.87 |
| MDSC_nm10 | cg2070-0740 | 0.98 | 0.94 | 0.97 | 0.96 | 0.93 | 0.97 | 0.98 | 0.97 | 0.98 |
| MDSC_nm11 | cg023-41139 | 0.88 | 0.84 | 0.89 | 0.91 | 0.89 | 0.88 | 0.89 | 0.83 | 0.83 |
| MDSC_nm12 | cg1998-4911 | 0.90 | 0.89 | 0.91 | 0.92 | 0.90 | 0.89 | 0.89 | 0.85 | 0.89 |
| MDSC_nm13 | cg221-37471 | 0.88 | 0.89 | 0.89 | 0.89 | 0.88 | 0.89 | 0.86 | 0.86 | 0.86 |
| MDSC_nm14 | cg0882-2891 | 0.88 | 0.78 | 0.88 | 0.91 | 0.91 | 0.91 | 0.90 | 0.88 | 0.87 |
| MDSC_nm15 | cg0047-6608 | 0.90 | 0.88 | 0.89 | 0.90 | 0.90 | 0.88 | 0.89 | 0.89 | 0.90 |
| MDSC_nm16 | cg2027-8790 | 0.89 | 0.84 | 0.87 | 0.89 | 0.90 | 0.85 | 0.87 | 0.84 | 0.86 |
| MDSC_nm17 | cg0869-7732 | 0.87 | 0.87 | 0.86 | 0.86 | 0.91 | 0.80 | 0.82 | 0.80 | 0.78 |
| MDSC_nm18 | cg008-64293 | 0.77 | 0.76 | 0.68 | 0.87 | 0.91 | 0.80 | 0.89 | 0.86 | 0.87 |
| MDSC_nm19 | cg1444-4376 | 0.86 | 0.78 | 0.84 | 0.89 | 0.86 | 0.81 | 0.78 | 0.81 | 0.83 |
| MDSC_nm20 | cg0094-5409 | 0.85 | 0.78 | 0.83 | 0.86 | 0.86 | 0.79 | 0.80 | 0.78 | 0.64 |
| MDSC_nm21 | cg0336-6992 | 0.84 | 0.84 | 0.80 | 0.87 | 0.87 | 0.84 | 0.86 | 0.79 | 0.84 |
| MDSC_nm22 | cg0417-3586 | 0.96 | 0.92 | 0.93 | 0.97 | 0.95 | 0.92 | 0.88 | 0.94 | 0.97 |
| MDSC_nm23 | cg0042-6089 | 0.87 | 0.76 | 0.81 | 0.89 | 0.84 | 0.83 | 0.80 | 0.78 | 0.83 |
| MDSC_nm24 | cg1086-4200 | 0.94 | 0.87 | 0.87 | 0.93 | 0.90 | 0.92 | 0.86 | 0.91 | 0.89 |
| MDSC_nm25 | cg0425-2044 | 0.81 | 0.82 | 0.71 | 0.91 | 0.87 | 0.85 | 0.90 | 0.82 | 0.85 |
| MDSC_nm26 | cg0190-5967 | 0.81 | 0.76 | 0.89 | 0.86 | 0.87 | 0.86 | 0.87 | 0.71 | 0.45 |
| MDSC_nm27 | cg035-00164 | 0.91 | 0.75 | 0.79 | 0.90 | 0.80 | 0.78 | 0.76 | 0.78 | 0.78 |
| MDSC_nm28 | cg0173-4240 | 0.82 | 0.79 | 0.79 | 0.86 | 0.87 | 0.80 | 0.77 | 0.84 | 0.76 |
| MDSC_nm29 | cg0912-7592 | 0.86 | 0.80 | 0.82 | 0.66 | 0.44 | 0.80 | 0.83 | 0.89 | 0.86 |

TABLE 4I-continued

MDSC (myeloid-derived suppressor cells) Marker

| MDSC_nm30 | CG090-88625 | 0.86 | 0.77 | 0.83 | 0.85 | 0.86 | 0.84 | 0.81 | 0.49 | 0.84 |
|---|---|---|---|---|---|---|---|---|---|---|
| MDSC_nm31 | cg1769-9214 | 0.76 | 0.76 | 0.74 | 0.83 | 0.88 | 0.74 | 0.78 | 0.75 | 0.78 |
| MDSC_nm32 | cg0793-7803 | 0.81 | 0.80 | 0.85 | 0.84 | 0.90 | 0.70 | 0.84 | 0.72 | 0.68 |
| MDSC_nm33 | cg2728-2397 | 0.83 | 0.84 | 0.82 | 0.85 | 0.83 | 0.81 | 0.79 | 0.78 | 0.77 |
| MDSC_nm34 | cg0135-9676 | 0.75 | 0.73 | 0.61 | 0.86 | 0.85 | 0.78 | 0.78 | 0.79 | 0.82 |
| MDSC_nm35 | cg054-76182 | 0.81 | 0.76 | 0.77 | 0.87 | 0.87 | 0.85 | 0.79 | 0.79 | 0.83 |
| MDSC_nm36 | cg1481-2474 | 0.79 | 0.68 | 0.77 | 0.83 | 0.82 | 0.79 | 0.79 | 0.76 | 0.81 |
| MDSC_nm37 | cg0821-0681 | 0.83 | 0.80 | 0.75 | 0.84 | 0.87 | 0.72 | 0.75 | 0.69 | 0.76 |
| MDSC_nm38 | cg1707-4014 | 0.91 | 0.86 | 0.81 | 0.80 | 0.84 | 0.56 | 0.80 | 0.83 | 0.96 |
| MDSC_nm39 | cg1532-0001 | 0.83 | 0.78 | 0.83 | 0.80 | 0.78 | 0.83 | 0.79 | 0.76 | 0.80 |
| MDSC_nm40 | cg1939-9285 | 0.73 | 0.76 | 0.69 | 0.79 | 0.87 | 0.61 | 0.66 | 0.67 | 0.77 |
| MDSC_nm41 | cg2116-4050 | 0.74 | 0.73 | 0.75 | 0.82 | 0.87 | 0.72 | 0.78 | 0.62 | 0.52 |
| MDSC_nm42 | cg2120-4530 | 0.69 | 0.70 | 0.61 | 0.76 | 0.85 | 0.73 | 0.71 | 0.70 | 0.78 |
| MDSC_nm43 | cg072-60017 | 0.68 | 0.61 | 0.68 | 0.79 | 0.86 | 0.62 | 0.69 | 0.67 | 0.67 |
| MDSC_nm44 | cg0619-3597 | 0.13 | 0.79 | 0.55 | 0.52 | 0.91 | 0.38 | 0.88 | 0.82 | 0.67 |
| MDSC_nm45 | cg2617-4398 | 0.61 | 0.71 | 0.59 | 0.76 | 0.84 | 0.65 | 0.72 | 0.62 | 0.60 |
| MDSC_nm46 | cg2458-7185 | 0.63 | 0.52 | 0.54 | 0.77 | 0.82 | 0.57 | 0.66 | 0.55 | 0.56 |
| MDSC_nm47 | cg0582-7190 | 0.79 | 0.78 | 0.74 | 0.83 | 0.89 | 0.75 | 0.77 | 0.75 | 0.79 |
| MDSC_nm48 | cg0317-6993 | 0.81 | 0.78 | 0.70 | 0.85 | 0.87 | 0.85 | 0.82 | 0.80 | 0.77 |
| MDSC_nm49 | cg0337-2334 | 0.87 | 0.68 | 0.72 | 0.56 | 0.85 | 0.88 | 0.81 | 0.85 | 0.86 |
| MDSC_nm50 | cg2187-7464 | 0.80 | 0.75 | 0.78 | 0.82 | 0.87 | 0.69 | 0.78 | 0.76 | 0.76 |
| MDSC_nm51 | cg0985-4726 | 0.79 | 0.68 | 0.70 | 0.82 | 0.89 | 0.70 | 0.73 | 0.69 | 0.62 |
| MDSC_nm52 | cg1649-0209 | 0.72 | 0.68 | 0.77 | 0.79 | 0.89 | 0.72 | 0.67 | 0.61 | 0.59 |
| MDSC_nm53 | cg181-14313 | 0.70 | 0.71 | 0.73 | 0.80 | 0.87 | 0.70 | 0.79 | 0.69 | 0.63 |
| MDSC_nm54 | cg223-07974 | 0.81 | 0.65 | 0.73 | 0.81 | 0.77 | 0.73 | 0.70 | 0.73 | 0.73 |
| MDSC_nm55 | cg191-32462 | 0.76 | 0.68 | 0.82 | 0.86 | 0.87 | 0.84 | 0.85 | 0.78 | 0.77 |

TABLE 4I-continued

MDSC (myeloid-derived suppressor cells) Marker

| | | | | | | | | | |
|---|---|---|---|---|---|---|---|---|---|
| MDSC_nm56 | cg1222-9979 | 0.72 | 0.74 | 0.66 | 0.79 | 0.84 | 0.75 | 0.72 | 0.70 | 0.61 |
| MDSC_nm57 | cg0609-3152 | 0.63 | 0.61 | 0.45 | 0.76 | 0.88 | 0.65 | 0.69 | 0.52 | 0.68 |

| Marker ID | Target ID | CD8+ NKT cells | NKT-Cells | Discovery Fragment |
|---|---|---|---|---|
| MDSC_nm1 | cg1031-7717 | 0.88 | 0.89 | CGCCTGGAGC CCGCCTCCAGC GCCTCCCACTG CAGACGTCTGT CGCTCTC (SEQ ID NO: 1284) |
| MDSC_nm2 | cg0936-5002 | 0.95 | 0.96 | CGCCGGGCCA ACACAGGATCT GATAGTGCAG GGTCAACGCCT ACGTGGGA (SEQ ID NO: 1285) |
| MDSC_nm3 | cg2249-6559 | 0.59 | 0.72 | CGCGCCCCAC GCCCCTGCCCA CAGGCCTGCAT TGAAGGCGCTT CCGCTC (SEQ ID NO: 1286) |
| MDSC_nm4 | cg2495-6391 | 0.81 | 0.87 | AAGGATGGCA TCCATCCGTAA AGGGCTTCCTC GGTCCAGCGCC AGGAACG (SEQ ID NO: 1287) |
| MDSC_nm5 | cg2278-8953 | 0.93 | 0.93 | CGCGGCCGAG CTGTCTGTCCA AGCCTGGGCCC CAGCACCCAG CGCAAGCT (SEQ ID NO: 1288) |
| MDSC_nm6 | cg0648-9615 | 0.91 | 0.91 | GAGTGTTGGCT CACGTGTTCCT GAGCCTGTCTG TTTTTAGTTAG TGTCCG (SEQ ID NO: 1289) |
| MDSC_nm7 | cg189-95788 | 0.85 | 0.90 | CGGGCAGATA CGAGCAGATT GACTCGCCAG GACTGTCATTG GGCCACCGC (SEQ ID NO: 1290) |
| MDSC_nm8 | cg1315-2501 | 0.91 | 0.91 | CTGACCTCATC CCGGAGGCCG CTTCAGTTCTC GAATGGATGTC TCTTCCG (SEQ ID NO: 1291) |
| MDSC_nm9 | cg1812-9996 | 0.89 | 0.90 | CGCCACAGGA ATGGCTCTTAT GATCCTTTTGG TGGCTAGATT TCTGAAA (SEQ ID NO: 1292) |

TABLE 4I-continued

| MDSC (myeloid-derived suppressor cells) Marker | | | | |
|---|---|---|---|---|
| MDSC_nm10 | cg2070-0740 | 0.97 | 0.98 | CCTCCTGTGAGCAACCTTTCGGCGTCTGCAGAGCTCGTGGCGTAAGAGCG (SEQ ID NO: 1293) |
| MDSC_nm11 | cg023-41139 | 0.82 | 0.85 | CGACAGCAATCCCGTGAGAAACTGTGGGACAGAACCACCCAGCTAAGCAG (SEQ ID NO: 1294) |
| MDSC_nm12 | cg1998-4911 | 0.88 | 0.89 | CGGCAAAGGCAGCCAATTGCTTGGCTGACGAAGCCAGGAAAATCCCACAT (SEQ ID NO: 1295) |
| MDSC_nm13 | cg221-37471 | 0.88 | 0.88 | AAAGAATGAGGTCACTGTCACCAATGAAGTCACCACTGCATGATTCATCG (SEQ ID NO: 1296) |
| MDSC_nm14 | cg0882-2891 | 0.87 | 0.88 | TGTGGATTCCTCCAAACTGTGATTGCTACATCTTAATTTTCAGCAGGACG (SEQ ID NO: 1297) |
| MDSC_nm15 | cg0047-6608 | 0.90 | 0.90 | AGATACTGGGGGACGTGCTTCGGTTGTCCTGGTCGATATCCCTGGGTCG (SEQ ID NO: 1298) |
| MDSC_nm16 | cg2027-8790 | 0.86 | 0.88 | TGGCAAGTCGCTCATGGAAACCATTAGTGTCCATCAGTCATCAGAAGGCG (SEQ ID NO: 1299) |
| MDSC_nm17 | cg0869-7732 | 0.75 | 0.76 | CCATAGCACCCCCATAATAAAGCAGCCCGTGAGGGCAGCCTGGCTGTTCG (SEQ ID NO: 1300) |
| MDSC_nm18 | cg008-64293 | 0.83 | 0.84 | CGGAGCAGGCCACAGTCAGGGTGGAAGAAAACGAGGGAAGACTGAGAAAC (SEQ ID NO: 1301) |
| MDSC_nm19 | cg1444-4376 | 0.77 | 0.85 | CGGCACTGCCTGATCTGGTCTCTCAAGTTCAACCTCTTACAACTCATGTG (SEQ ID NO: 1302) |
| MDSC_nm20 | cg0094-5409 | 0.79 | 0.80 | GCCTTGTCCTGGGGCTGAGCA |

TABLE 4I-continued

MDSC (myeloid-derived suppressor cells) Marker

| | | | | |
|---|---|---|---|---|
| | | | | GTGGTGCAACC CAGCCCTGAG CAATTCCG (SEQ ID NO: 1303) |
| MDSC_nm21 | cg0336-6992 | 0.85 | 0.85 | CCACCTGAGGT GAGCAATCAG AGGACACCCCT CGAGTCACTGG GAGTTCG (SEQ ID NO: 1304) |
| MDSC_nm22 | cg0417-3586 | 0.90 | 0.96 | CGGCACAGTCC CGCCCACCACT AGAAAGCCCG CTCCCGCCAGC TCTCGCC (SEQ ID NO: 1305) |
| MDSC_nm23 | cg0042-6089 | 0.74 | 0.85 | AGCTTTGTATA GATGCATGCAC TTGGAAACCA GCAAAGCTAA AAATACCG (SEQ ID NO: 1306) |
| MDSC_nm24 | cg1086-4200 | 0.93 | 0.93 | CGCAGGAGCG CACACACGTTC CCACACGCCAC TCAATTCCAGA ACAACGG (SEQ ID NO: 1307) |
| MDSC_nm25 | cg0425-2044 | 0.85 | 0.86 | GTATGTGTGAG TCAATCTAATG TGCCCTCCCTC AGCATAATCCT GTCACG (SEQ ID NO: 1308) |
| MDSC_nm26 | cg0190-5967 | 0.53 | 0.66 | TGGAAATCTCT TTCGTCAAGGC CTCTAGTGACC GCTGGGGATTC TTCTCG (SEQ ID NO: 1309) |
| MDSC_nm27 | cg035-00164 | 0.74 | 0.86 | TCATACATTTC AACTTGCTGCT GTTCTGAGTAG CGTGATGAAAT CTTGCG (SEQ ID NO: 1310) |
| MDSC_nm28 | cg0173-4240 | 0.81 | 0.82 | CGGAGTAGTCT TGAAAGACAT GACAAATCAC CAGACCTGGG AAGAAGCTA (SEQ ID NO: 1311) |
| MDSC_nm29 | cg0912-7592 | 0.85 | 0.90 | GGCGGCGGGG CACAGCGTGG GGGTGTGCAGT GACTGAGAGA TGGTTCACG (SEQ ID NO: 1312) |
| MDSC_nm30 | CG090-88625 | 0.68 | 0.64 | GAATGATCTCT GCACTGTAGG ACATCCTTGGC CCTGCCTACCA AATGACG (SEQ ID NO: 1313) |

TABLE 4I-continued

MDSC (myeloid-derived suppressor cells) Marker

| | | | | |
|---|---|---|---|---|
| MDSC_nm31 | cg1769-9214 | 0.80 | 0.78 | CGGCTGTTCCAGACCCTAATGAGTTCAGTTGTCCTACAAAGCAGGAAGAG (SEQ ID NO: 1314) |
| MDSC_nm32 | cg0793-7803 | 0.71 | 0.69 | CGGGGTGTCACTCCTACAAGACAAGAAAAGCCCAGGATTGCTGGCCAATG (SEQ ID NO: 1315) |
| MDSC_nm33 | cg2728-2397 | 0.80 | 0.82 | TACACAGTTCCCTGCACACACTCGGCTAACTGTGACCAGGGTGAGAGCG (SEQ ID NO: 1316) |
| MDSC_nm34 | cg0135-9676 | 0.81 | 0.80 | ATGACCCTGTGACTAACATCTGTCAGGCAGCTGACAAACAGCTATTCACG (SEQ ID NO: 1317) |
| MDSC_nm35 | cg054-76182 | 0.81 | 0.81 | CTGTTAGGCAGAGCAGCCTAATGGGAGCAGTGTGACTCATGGACCTCACG (SEQ ID NO: 1318) |
| MDSC_nm36 | cg1481-2474 | 0.77 | 0.76 | TCATCCAAGCTTGTGTGAGTCACAATGAGCAGAAAGCATTCTTCCACCCG (SEQ ID NO: 1319) |
| MDSC_nm37 | cg0821-0681 | 0.64 | 0.77 | CGGCCCCAGCACTGCAAAGCTGTCATCGCTCCTCTCCAGGGAGCCATCCT (SEQ ID NO: 1320) |
| MDSC_nm38 | cg1707-4014 | 0.85 | 0.89 | CGGCCCATGTGTCGCACTCGCCTCGGCTCCCACACAGCGCCTCTGCTCC (SEQ ID NO: 1321) |
| MDSC_nm39 | cg1532-0001 | 0.81 | 0.81 | CTACTTTCAATCTCTATGGATTTCCCTATTCAGGACATTTTCTATAAACG (SEQ ID NO: 1322) |
| MDSC_nm40 | cg1939-9285 | 0.73 | 0.74 | TATGCTTACTCCCTCTCCCTCTTGTCTGTGTCCCTGTGTGGCCTGAAGCG (SEQ ID NO: 1323) |
| MDSC_nm41 | cg2116-4050 | 0.56 | 0.53 | CGGAGAGCCAACACCACCAGTCAGTCACCCAAGCTGGAAATTTAAGCATC (SEQ ID NO: 1324) |

TABLE 4I-continued

| MDSC (myeloid-derived suppressor cells) Marker ||||| 
|---|---|---|---|---|
| MDSC_nm42 | cg2120-4530 | 0.67 | 0.71 | CGTCTGCAAGA ACAGGGGAGA ACTAAGGTCCC AAGCAGCAAA AGTTAAAA (SEQ ID NO: 1325) |
| MDSC_nm43 | cg072-60017 | 0.70 | 0.68 | CGGCATCTTCA TTTGAGTGGGT GCGGGAAGGA CCTCATTTTGG AACCACA (SEQ ID NO: 1326) |
| MDSC_nm44 | cg0619-3597 | 0.83 | 0.74 | CGCGTGCCTCT GTGCAGTCAGT GAG AAGGGCT CCCGTTCAGAA TGGGCAG (SEQ ID NO: 1327) |
| MDSC_nm45 | cg2617-4398 | 0.65 | 0.63 | CGTGAGCCAG AGAGAGCTGG CTTTCAGTGTT GTCACCATGGT TACTGCTA (SEQ ID NO: 1328) |
| MDSC_nm46 | cg2458-7185 | 0.56 | 0.63 | CGACTGCTCCT CTGGCAAGCA GGACCCATTTC TAAAGCATGA GTCACTAC (SEQ ID NO: 1329) |
| MDSC_nm47 | cg0582-7190 | 0.79 | 0.78 | CGCTTCAGACG CATCTCTTCTC AGTGAGTCAG CTGTGGGCCCC ACTCAGG (SEQ ID NO: 1330) |
| MDSC_nm48 | cg0317-6993 | 0.72 | 0.72 | CGGAAAACTT GCTAATGCTGG CTGATTCTCAT TGCTGGGTTTA CTAGTTC (SEQ ID NO: 1331) |
| MDSC_nm49 | cg0337-2334 | 0.85 | 0.70 | CGCTTTATGGA GCAGCAAAGA AAGTAGTTTCT TGAGATGGGTT CTACTCT (SEQ ID NO: 1332) |
| MDSC_nm50 | cg2187-7464 | 0.76 | 0.76 | TAAAATTATTT TTTTCCCTAAA CCCAATCTCTC CTCTTCCTCCT CTGTCG (SEQ ID NO: 1333) |
| MDSC_nm51 | cg0985-4726 | 0.74 | 0.68 | CGCTGTCAGGA ATTGTCTCCTG GTTCAACCCAC TCCTGCCTTAG GCCCAC (SEQ ID NO: 1334) |

TABLE 4I-continued

| MDSC (myeloid-derived suppressor cells) Marker | | | | |
|---|---|---|---|---|
| MDSC_nm52 | cg1649-0209 | 0.60 | 0.57 | CGATGGTGAGCAAAAGGTGTTGACAGGCCTGGCATGGTGACTCACCCCTG (SEQ ID NO: 1335) |
| MDSC_nm53 | cg181-14313 | 0.69 | 0.64 | TCCAAGTCACACAGCCCTTAAATGAGCCACCAGGTTACCTTTGCATCACG (SEQ ID NO: 1336) |
| MDSC_nm54 | cg223-07974 | 0.72 | 0.74 | CGGAGGCCCAGAGAAGGGAAGTGACATGCTCAAGGTAACACTGCTAACCA (SEQ ID NO: 1337) |
| MDSC_nm55 | cg191-32462 | 0.75 | 0.71 | CGTGAGGTTGTGTCTTACTGAGCTCACATCATAATTCCTGTGTGCACAGA (SEQ ID NO: 1338) |
| MDSC_nm56 | cg1222-9979 | 0.63 | 0.63 | CGAGGACAGTTCCTCCAGAAATCCAGGTCAGTCACAAGACAAAGAAAAGA (SEQ ID NO: 1339) |
| MDSC_nm57 | cg0609-3152 | 0.57 | 0.47 | CGGCCTCTGAGAGCTGACACGGAACTTGCATCATTTCTGATGCTTGGCTC (SEQ ID NO: 1340) |

TABLE 4J

| Marker-ID | Target-ID | SYMBOL | Accession | Baso-phil Granulo-cytes | Eosino-phil Granulo-cytes | Neutro-phil Granulo-cytes | Non-clas-sical Mono-cytes | Clas-sical Mono-cytes | NK cells | B-Cells | CD4+ Th naive | CD4+ Th Th1 | CD4+ Th Th2 | CD4+ Th Central Mem. | CD4+ Th Effectoral Mem. | CD8+ Cytotoxic T-Cells | NK T-Cells | Discovery Fragment |
|---|---|---|---|---|---|---|---|---|---|---|---|---|---|---|---|---|---|---|
| LYMP_nm1 | cg14437551 | LTA | NM_000595 | 0.94 | 0.96 | 0.95 | 0.95 | 0.96 | 0.13 | 0.04 | 0.11 | 0.02 | 0.02 | 0.02 | 0.03 | 0.04 | 0.03 | AGAGGAAGCGGC AGTGGCAGCGTGG CAGGCAGCGGGCG GGTTCTAGGTCG (SEQ ID NO: 1341) |
| LYMP_nm2 | cg02668248 | KLF2 | NM_016270 | 0.89 | 0.90 | 0.93 | 0.90 | 0.80 | 0.04 | 0.06 | 0.10 | 0.02 | 0.03 | 0.02 | 0.06 | 0.03 | 0.05 | CGTGCCTTCTCGC GCTCCGATCACCT GGCGCTGCACATG AAACGGCACAT (SEQ ID NO: 1342) |
| LYMP_nm3 | cg00446123 | LIME1 | NM_017806 | 0.78 | 0.68 | 0.89 | 0.78 | 0.72 | 0.03 | 0.05 | 0.05 | 0.03 | 0.03 | 0.03 | 0.03 | 0.02 | 0.02 | TCAGAACAGTGCG GGCTAGAGGCGCA CACGTTTCATCTA GGCTTCGGGCG (SEQ ID NO: 1343) |
| LYMP_nm4 | cg21959598 | VOPP1 | NM_030796 | 0.84 | 0.81 | 0.89 | 0.87 | 0.84 | 0.08 | 0.12 | 0.17 | 0.10 | 0.11 | 0.13 | 0.12 | 0.17 | 0.08 | ATAAAGCAACCC AGGGAGCTATTTG GTGGCTTCTGGCT TCTGACTGCCG (SEQ ID NO: 1344) |
| LYMP_nm5 | cg17161520 | TBC1D10C | NM_198517 | 0.83 | 0.82 | 0.81 | 0.79 | 0.73 | 0.08 | 0.05 | 0.09 | 0.11 | 0.08 | 0.10 | 0.15 | 0.05 | 0.09 | GGTGCTCACTGGC TCCAGACGTGGAT CTGCAGCTGGGAA TCAAGTGATCG (SEQ ID NO: 1345) |
| LYMP_nm6 | cg03961551 | RUNX3 | NM_001031680.61 | | 0.77 | 0.85 | 0.85 | 0.79 | 0.08 | 0.13 | 0.08 | 0.06 | 0.06 | 0.07 | 0.08 | 0.07 | 0.07 | TTTCCCAGTCAGC AGGATGGCACTG CAGATGTGTCT GCATGCCAGCG (SEQ ID NO: 1346) |
| LYMP_nm7 | cg04450994 | SLC22A23 | NM_021945 | 0.53 | 0.78 | 0.79 | 0.77 | 0.81 | 0.04 | 0.17 | 0.03 | 0.01 | 0.03 | 0.03 | 0.03 | 0.04 | 0.02 | CGGGCTCTCACAC GTGGGCCACCATC CGCCTGCCCCAGT CACCCGGGGC (SEQ ID NO: 1347) |

TABLE 4J-continued

| ID | Probe/Gene | | | | | | | | | | | | | | | | Sequence |
|---|---|---|---|---|---|---|---|---|---|---|---|---|---|---|---|---|---|
| LYMP_nm8 | cg18920397LY9 | NM_001033667 | 0.81 | 0.83 | 0.83 | 0.68 | 0.63 | 0.08 | 0.14 | 0.09 | 0.05 | 0.05 | 0.05 | 0.07 | 0.05 | 0.06 | CGCAGGCAGGTAG AGGTCCCAAGTCT ATTCAGGCCTCA TTTGTGACTGA (SEQ ID NO: 1348) |
| LYMP_nm9 | cg18825221RAD51L1 | NM_133509 | 0.64 | 0.66 | 0.73 | 0.71 | 0.65 | 0.11 | 0.04 | 0.04 | 0.02 | 0.03 | 0.02 | 0.03 | 0.04 | 0.07 | AGAAAGCACCACA GGTAATAAAAACA CCTAAAAAGGTCA GCAGAAACTCG (SEQ ID NO: 1349) |
| LYMP_nm10 | cg11327657C21orf0 | NM_058190 | 0.02 | 0.02 | 0.01 | 0.02 | 0.04 | 0.94 | 0.97 | 0.95 | 0.97 | 0.96 | 0.98 | 0.96 | 0.96 | 0.97 | CGCAACCCCCAGT GACACAACCCCA GTGACGCAACCCC GTGACCCAATG SEQ ID NO: 1350) |
| LYMP_nm11 | CG11597902 | — | 0.03 | 0.02 | 0.10 | 0.03 | 0.06 | 0.95 | 0.95 | 0.94 | 0.96 | 0.96 | 0.95 | 0.95 | 0.97 | 0.96 | CGAGGAGCGGGCG TGCTGCGCTGCTT CTCTTTGAGTCATC TGGGTCCTCG (SEQ ID NO: 1351) |
| LYMP_nm12 | cg21159128SSBP3 | NM_001009955 | 0.03 | 0.01 | 0.00 | 0.02 | 0.05 | 0.95 | 0.86 | 0.95 | 0.93 | 0.92 | 0.94 | 0.93 | 0.96 | 0.93 | CGACAATGTAAGC CTCGCCCCTGCC TGTTGCTCTCGTCC CCACGGCTG (SEQ ID NO: 1352) |
| LYMP_nm13 | cg05327789SLCO4A1 | NM_0616354 | 0.03 | 0.01 | 0.01 | 0.01 | 0.07 | 0.82 | 0.95 | 0.95 | 0.94 | 0.95 | 0.93 | 0.95 | 0.96 | 0.87 | CGGCCACGGCGGG CACTCAGCATTTC CTGATGACAGAAC AGTGCCGTTGG (SEQ ID NO: 1353) |
| LYMP_nm14 | cg26709988CRISPLD2 | NM_031476 | 0.19 | 0.03 | 0.03 | 0.04 | 0.09 | 0.96 | 0.96 | 0.95 | 0.96 | 0.96 | 0.97 | 0.95 | 0.97 | 0.97 | CGCAAAAGCCTTG CAACACAACAG CACAGACAAACCC CGCAGACACGG (SEQ ID NO: 1354) |
| LYMP_nm15 | cg05260077 | — | 0.05 | 0.03 | 0.03 | 0.02 | 0.06 | 0.90 | 0.91 | 0.90 | 0.91 | 0.90 | 0.89 | 0.89 | 0.92 | 0.90 | ATTTCGAAATAAA GGAGCTTGCATGA ATGACGATTTCCA AACTTCTCTCG (SEQ ID NO: 1355) |
| LYMP_nm16 | cg10690440 | — | 0.13 | 0.24 | 0.06 | 0.02 | 0.06 | 0.95 | 0.97 | 0.96 | 0.96 | 0.98 | 0.96 | 0.97 | 0.95 | CCTGCGCTCTGAC ACCAGCCGTGTAA GGGCACAGACTCG GCTGCTGTTCG (SEQ ID NO: 1356) |

TABLE 4J-continued

| | | | | | | | | | | | | |
|---|---|---|---|---|---|---|---|---|---|---|---|---|
| LYMP_nm17 cg20429104ZNF516 | NM_014643 | 0.28 | 0.05 | 0.02 | 0.04 | 0.08 | 0.96 | 0.97 | 0.96 | 0.96 | 0.97 | 0.96 | 0.96 | 0.93 | CGTTCAGATCTGT TGCGACTCTTCAG ATCACTTCCCGTTT TGCAATCACG (SEQ ID NO: 1357) |
| LYMP_nm18 cg0286247 UBR4 | NM_020765 | 0.07 | 0.03 | 0.03 | 0.04 | 0.09 | 0.90 | 0.86 | 0.90 | 0.92 | 0.91 | 0.92 | 0.93 | 0.93 | 0.92 | CACATCCTGCCCC CTGAGCAGTGGAG AGCCACACGTGTG GAAATCTTGCG (SEQ ID NO: 1358) |
| LYMP_nm19 cg0050035905BPL5 | NM_020896 | 0.04 | 0.02 | 0.01 | 0.16 | 0.26 | 0.92 | 0.97 | 0.96 | 0.96 | 0.96 | 0.97 | 0.96 | 0.97 | 0.96 | CGCCCCACTTTGCC GGTGGGACAGAGT GGCTGACGGCGTG TGGCACAGGCG (SEQ ID NO: 1359) |
| LYMP_nm20 cg11186858— | — | 0.11 | 0.05 | 028 | 0.05 | 0.10 | 0.95 | 0.95 | 0.96 | 0.97 | 0.98 | 0.97 | 0.96 | 0.98 | 0.97 | CGCACTAACGTGA ATGCCGCATGTAC AGATGACCACAGT GCTCGGAGGGT (SEQ ID NO: 1360) |
| LYMP_nm21 cg15085899NCOR2 | NM_006312 | 0.03 | 0.06 | 0.01 | 0.01 | 0.01 | 0.72 | 0.43 | 0.89 | 0.97 | 0.97 | 0.98 | 0.96 | 0.97 | 0.97 | GAGTGGCAGAGGC GAGAACGGATCGC TGGAGGCCCGACG TCTCGTTCACG (SEQ ID NO: 1361) |
| LYMP_nm22 cg08400494CARS2 | NM_024537 | 0.04 | 0.02 | 0.04 | 0.15 | 0.11 | 0.95 | 0.83 | 0.93 | 0.95 | 0.95 | 0.94 | 0.94 | 0.96 | 0.94 | ATATTTAAGGCAT CGCCCCTCAGGGA GCCGAGCACTGAT TTCCACAGCCG (SEQ ID NO: 1362) |
| LYMP_nm23 cg19851816TUBGCP6 | NM_020461 | 0.02 | 0.02 | 0.00 | 0.01 | 0.03 | 0.85 | 0.62 | 0.83 | 0.89 | 0.92 | 0.90 | 0.92 | 0.92 | 0.93 | CGTGCGTGCTCCA TCTCCCGCAGCCG AGCCGCCCATTGC TCATCTTTTGC (SEQ ID NO: 1363) |
| LYMP_nm24 cg23568192— | — | 0.05 | 0.04 | 0.02 | 0.05 | 0.10 | 0.89 | 0.87 | 0.90 | 0.89 | 0.88 | 0.90 | 0.90 | 0.94 | 0.91 | AGCGGGTAAGTAA TGCATTCAAGGTT GCACAACTAGTAA ATGCTTCATCG (SEQ ID NO: 1364) |

TABLE 4J-continued

| | | | | | | | | | | | | | | |
|---|---|---|---|---|---|---|---|---|---|---|---|---|---|---|
| LYMP_nm25 cg00168694ETS2 | NM_005239 | 0.06 | 0.07 | 0.04 | 0.04 | 0.08 | 0.84 | 0.93 | 0.92 | 0.90 | 0.91 | 0.91 | 0.92 | 0.93 0.87 CGTGGGATCCCAT GCCACCTTCCTGC CAAATGACCATGT GTAAATTGCTT (SEQ ID NO: 1365) |
| LYMP_nm26 cg06298740- | — | 0.07 | 0.10 | 0.04 | 0.04 | 0.09 | 0.90 | 0.91 | 0.91 | 0.91 | 0.91 | 0.91 | 0.92 | 0.92 0.92 CGAACCAGGAACT CTCTTATTCCATGG ACTGTGGTCTGGG TCAGTAGGCT (SEQ ID NO: 1366) |
| LYMP_nm27 cg20078972BRD4 | NM_058243 | 0.05 | 0.04 | 0.03 | 0.04 | 0.06 | 0.87 | 0.88 | 0.88 | 0.89 | 0.89 | 0.89 | 0.90 | 0.90 0.87 CGGCTCTTTTAATT GTGCAATCTGTGT CAGTGGGAAGCA CAAATAGGAT (SEQ ID NO: 1367) |
| LYMP_nm28 cg26942829GFOD1 | NM_018988 | 0.06 | 0.07 | 0.05 | 0.05 | 0.11 | 0.90 | 0.91 | 0.91 | 0.90 | 0.90 | 0.91 | 0.90 | 0.92 0.90 CGGAGATTGCCCA ACCAAAGAGCAGA AGTTCACAGAATA TCTCTTCTTGG (SEQ ID NO: 1368) |
| LYMP_nm29 cg03408945C16orf68 | NM_024109 | 0.26 | 0.01 | 0.01 | 0.01 | 0.06 | 0.82 | 0.88 | 0.85 | 0.94 | 0.93 | 0.92 | 0.93 | 0.92 0.96 CGGGCTCCACCAC GAAGCGCAGCTTG CCATCTGCGAGCT GCTCCAGCGCG (SEQ ID NO: 1369) |
| LYMP_nm30 cg06373940ERCC3 | NM_000122 | 0.06 | 0.05 | 0.06 | 0.06 | 0.14 | 0.90 | 0.84 | 0.90 | 0.92 | 0.92 | 0.94 | 0.91 | 0.93 0.92 GTATTTGTTACAG CAGTACCCTATTC CCCGTACCAAAAA TCTGTGTTACG (SEQ ID NO: 1370) |
| LYMP_nm31 cg25576997C14orf34 | NR_026796 | 0.05 | 0.04 | 0.04 | 0.04 | 0.08 | 0.91 | 0.86 | 0.91 | 0.85 | 0.85 | 0.88 | 0.86 | 0.90 0.90 AATGATGAAATCC AGCCATTCTGACA CTGTTCCTTATCTA GGATCTCTCG (SEQ ID NO: 1371) |
| LYMP_nm32 cg11703212TFDP1 | NR_026580 | 0.07 | 0.05 | 0.06 | 0.06 | 0.13 | 0.91 | 0.89 | 0.92 | 0.92 | 0.92 | 0.91 | 0.93 | 0.92 0.94 GAGTCTCGAGAGA GCAATGTCTCCAT GGAGCGGGTGCCT GGCTGTGGTCG (SEQ ID NO: 1372) |
| LYMP_nm33 cg06474225HTRA1 | NM_002775 | 0.03 | 0.21 | 0.06 | 0.02 | 0.04 | 0.93 | 0.93 | 0.92 | 0.87 | 0.88 | 0.90 | 0.89 | 0.89 0.84 CGGCGAATCTCAT CAAACTTTGAGAA AAAAAACAGCTC ATCACAGAGAT (SEQ ID NO: 1373) |

TABLE 4J-continued

| | | | | | | | | | | | | |
|---|---|---|---|---|---|---|---|---|---|---|---|---|
| LYMP_nm34 cg04739200MYB | NM_005375 | 0.10 | 0.04 | 0.03 | 0.05 | 0.08 | 0.88 | 0.90 | 0.89 | 0.89 | 0.90 | 0.89 | 0.88 | CGCCAGCAAGGTG CATGATCGTCCAC CAGGGCACCATTC TGGATAATGTT (SEQ ID NO: 1374) |
| LYMP_nm35 cg07283015HRH4 | NM_021624 | 0.08 | 0.06 | 0.04 | 0.07 | 0.15 | 0.92 | 0.93 | 0.91 | 0.91 | 0.89 | 0.90 | 0.91 | CGGATGAGGTCTG CAGTTGCCCCACC TTACTATCTTGAG AGTTCCCAGGG (SEQ ID NO: 1375) |
| LYMP_nm36 cg10456459ETNK1 | NM_018638 | 0.11 | 0.15 | 0.06 | 0.05 | 0.11 | 0.93 | 0.92 | 0.91 | 0.92 | 0.92 | 0.93 | 0.94 | ACGAATTTAAGCT TTATGCCACAATT TCCCAATTCAACA TAAAGCTAACG (SEQ ID NO: 1376) |
| LYMP_nm37 cg20312012FERIL5 | NM_0011133820 | 0.08 | 0.08 | 0.06 | 0.05 | 0.08 | 0.86 | 0.90 | 0.90 | 0.91 | 0.90 | 0.91 | 0.91 | GTTTTGTTTCCTCA TACCTTACATTGT GAAATACAAAATT AGCTAAATGCG (SEQ ID NO: 1377) |
| LYMP_nm38 cg04478251ABR | NM_021962 | 0.44 | 0.11 | 0.14 | 0.07 | 0.10 | 0.96 | 0.95 | 0.94 | 0.97 | 0.96 | 0.96 | 0.97 | CGCGACGCGCTCA TCTGCCACCCACA CGAAGACAAAACA CAATGGTTATG (SEQ ID NO: 1378) |
| LYMP_nm39 cg06030535- | — | 0.05 | 0.05 | 0.05 | 0.05 | 0.06 | 0.89 | 0.88 | 0.88 | 0.88 | 0.86 | 0.87 | 0.88 | CAGAGGCCAGAGA CTTGAATTTACAA GGAGGGTCCTCAA CACAGACATCG (SEQ ID NO: 1379) |
| LYMP_nm40 cg07714276RREB1 | NM_001003700 | 0.14 | 0.06 | 0.06 | 0.05 | 0.08 | 0.87 | 0.87 | 0.90 | 0.91 | 0.91 | 0.90 | 0.91 | CCCTGGTATTTC TCACTTTCTTGCC TAACTTAGCAGAA ACATGTATCG (SEQ ID NO: 1380) |
| LYMP_nm41 cg17374091TRIM27 | NM_006510 | 0.26 | 0.05 | 0.02 | 0.02 | 0.05 | 0.89 | 0.90 | 0.90 | 0.89 | 0.91 | 0.89 | 0.90 | GTTACACTATAAA TAGATGTTCACTG ACCAAATACTCCT ACTAGTTCTCG (SEQ ID NO: 1381) |

TABLE 4J-continued

| | | | | | | | | | | | | |
|---|---|---|---|---|---|---|---|---|---|---|---|---|
| LYMP_nm42 cg02353916LOC285550 | NM_001145191 | 0.04 | 0.02 | 0.07 | 0.03 | 0.07 | 0.89 | 0.85 | 0.89 | 0.88 | 0.86 | 0.90 | 0.88 | 0.85 | CGGCATTGATGTT GCTTCACGTTGCT GATGCTTAAGCAA TGTATATTGTG (SEQ ID NO: 1382) |
| LYMP_nm43 cg23506143- | - | 0.12 | 0.08 | 0.06 | 0.04 | 0.05 | 0.91 | 0.89 | 0.85 | 0.86 | 0.88 | 0.90 | 0.86 | 0.92 | 0.90 | CGTCGTCTTTAAA ATGTGCTATCATTT CCTTGTTATAGTTG TGCAAGATT (SEQ ID NO: 1383) |
| LYMP_nm44 cg13086983ECE1 | NM_001113480 | 0.06 | 0.07 | 0.04 | 0.05 | 0.09 | 0.88 | 0.83 | 0.88 | 0.90 | 0.90 | 0.90 | 0.90 | 0.89 | TGGCTCCAGTTTC CAAGTGACGCAAC CAAGTGTCTGGAT TCAGAGAATCG (SEQ ID NO: 1384) |
| LYMP_nm45 cg12249234KSR1 | NM_014238 | 0.08 | 0.05 | 0.04 | 0.04 | 0.08 | 0.86 | 0.86 | 0.88 | 0.87 | 0.89 | 0.87 | 0.89 | 0.90 | 0.86 | ACAAATGTAAAAG CCTGGCAGCTTCC CCAGGAGAGTGCG GGTATGGGCCG (SEQ ID NO: 1385) |
| LYMP_nm46 cg13381110PHLPP1 | NM_194449 | 0.12 | 0.08 | 0.06 | 0.06 | 0.14 | 0.83 | 0.89 | 0.90 | 0.93 | 0.93 | 0.91 | 0.92 | 0.94 | 0.94 | CATAGTGGCGTGT CGTAATAATCTGG CAGCTGGTCCAGC TGGTAGTGCCG (SEQ ID NO: 1386) |
| LYMP_nm47 cg01990910SNX29 | NM_001080530 | 0.01 | 0.03 | 0.02 | 0.01 | 0.03 | 0.38 | 0.59 | 0.88 | 0.96 | 0.97 | 0.96 | 0.96 | 0.93 | 0.94 | CGCCGGCCAAATG CAACCAGCAGAGA TATGACCCCGACC CGTCTAAAGCC (SEQ ID NO: 1387) |
| LYMP_nm48 cg25103337H6PD | NM_004285 | 0.04 | 0.04 | 0.02 | 0.02 | 0.05 | 0.76 | 0.73 | 0.87 | 0.89 | 0.90 | 0.88 | 0.89 | 0.89 | 0.88 | TGGGGCCAACAGG CATGATTACCACA CAGGATGTTAGGC AAGGGGTTCCG (SEQ ID NO: 1388) |

In table 4, regions that contain CpGs that are specific for the blood cell types granulocytes, monocytes, CD4+ cells, cytotoxic T-cells, B-cells, Natural Killer-cells, and Natural Killer T-cells are listed, as well as their SEQ ID NOs for the so-called "discovery fragment" (preferred region) and the discriminative "region of interest" (more preferred region). The discovery fragments comprise at least one CpG that is specific for the cell type as indicated, and thus suitable to distinguish this cell type from all other cell types of the haemogram. The discriminative region of interest (ROI) sequences are regions that are positioned around the discovery region, and which form the basis for the design of the specific assay for a specific cell type as indicated, and contain additional relevant CpGs, that is, a sequence of CpGs that can also be used in order to distinguish between the call types as indicated.

In table 4A to 4J, regions that contain CpGs that are specific for the respective blood cell types as shown in each table header are listed. The sequence provided in the column "discovery fragment" is the preferred region and comprises at least one CpG that is specific for the cell type of the respective table (identifiable by the shown data). Also comprised in the context of the various embodiments and aspects of the invention is a region 500 base pairs upstream and downstream of (therefore "around") the sequence of the "discovery fragment" in the human genome for each marker. The region 500 base pairs upstream and downstream of the "discovery fragment" are the discriminative ROI of the marker of the tables 4A to 4J.

The present invention therefore also pertains to a bisulfite conversion of at least one CpG position within any one of the "discovery fragments" or ROI (500 bp up and downstream for each "discovery fragment" in the human genome) of any one of the Tables 4 and 4A to 4J as shown above, which is indicative for a respective cell type as listed in the tables 4. The T-lymphocytogram in all of the embodiments and aspects of the invention may therefore contain any of the cell types listed in the above tables 4 and 4A to 4J, and any combinations of these cell types.

An additional region for neutrophilic granulocytes (nGRC) is derived from the Lipocalin-2, neutrophil gelatinase-associated lipocalin (LCN2) genomic region (Ensembl-ID: ENSG00000148346); herein designated AMP1730. The AMP 1730 genomic sequence and the discriminative ROI 1132 are SEQ ID NOs: 686 and 685 respectively. See also FIG. 2.

Additional regions for eosinophilic granulocytes (eGRC) are derived from the proteoglycan 2 (PRG2) genomic region (Ensembl-ID: ENSG00000186652), herein designated as AMP 2034 and 2035, respectively. The AMP 2034 and 2035 genomic sequences, and the discriminative ROI1403 are SEQ ID NOs: 687, 688, and 689, respectively. See also FIG. 3.

Preferably, the cell-specific gene regions as described herein are selected to discriminate one cell type or subpopulation of cells from all other cell types, such as the leukocytogram, T-lymphocytogram, granulocytogram, monocytogram, B-lymphocytogram and/or NK cytogram as described herein. Thus, highly specific cell-type markers are used as a basis for identification and quantification that are not based on protein expression levels but on cell type-specific epigenetic information. The method provides a clear yes/no information and is independent of thresholding as the cell-specific CpG-rich genomic region is bisulfite convertible or not, is detectable by qPCR or not as well as genomic copies do not vary. The method also detects and identifies as well as quantifies a potentially unlimited number of subpopulations of cells, and the detection limit for, for example, regulatory T cells is at 0.3%.

Preferred is a method according to the present invention, wherein the cells that are detected and thus for the epigenetic haemogram are selected from a leukocytogram, and/or a T-lymphocytogram, and/or a granulocytogram, and/or a monocytogram, and/or a B-lymphocytogram, and/or a NK cytogram.

Preferably, said marker regions as analyzed are specific for the cells of a pre-selected haemogram, and these cells are preferably selected from T-lymphocytes, natural killer cells, B-lymphocytes, monocytes, granulocytes, and combinations thereof, for a leukocytogram, selected from $CD3^+CD4$, $CD4_+$ memory, $CD4^+$ effector cells, $CD4^+$ naïve, $CD3^+CD8^+$, CD8 positive, $CD8^+$ memory, $CD8^+$ effector cells, $CD8^+$ naïve, $CD3^+CD8^-CD4^-$, $CD3^+CD8^+CD4^+$, NKT cells, iTreg, Treg, Tfh, Th1, Th2, TH9, Th17, Th19, Th21, Th22, memory and effector T helper cells, and combinations thereof, for a T-lymphocytogram, selected from basophilic, eosinophilic, neutrophilic granulocytes, and/or granulocytic myeloid-derived suppressor cells, and combinations thereof, for a granulocytogram, selected from $CD14^+$ monocytes, $CD14^-$ monocytes, macrophages, plasmacytoid dendritic cells, myeloid-dendritic cells, intermediate monocytes, classical monocytes, non-classical monocytes, and/or overall dendritic cells, and combinations thereof, for a monocytogram, selected from naïve B cells, pre B cells, memory B cells, transitional B cells and/or immature B cells, and combinations thereof, for a B cell cytogram, and selected from $CD56^{dim}$ and/or $CD56^{bright}$ NK cells for an NK cytogram.

In contrast to the term "cell-specific regions", the term "cell-unspecific regions" herein shall mean genetic regions in the genome of cells and/or nucleic acids that are selected to be unspecific, i.e. are specific for more than one, preferably all, cell type and/or subpopulation of cells. These cell-unspecific regions also include the genes of certain markers (such as, for example, certain protein markers), such as 5' untranslated regions, promoter regions, introns, exons, intron/exon borders, 3' regions, CpG islands, and in particular include specific regions as amplified after bisulfite treatment (amplicons) that are "informative" for more than one cell type and/or subpopulation of cells. Examples for these cell-unspecific regions are known from the literature, and are selected from, for example regions comprising a housekeeping gene, such as GAPDH, ACTB (beta-actin), UBC (ubiquitin C), ribosomal proteins (e.g. RPS27A, RPS20, RPL11, RPL38, RPL7, RPS11, RPL26L1), CALR (calreticulin), ACTG1 (gamma actin) RPS20 (ribosomal protein S20), HNRPD (ribonucleoprotein D), NACA (nascent polypeptide-associated complex subunit alpha), NONO (octamer-binding protein), PTMAP7 (prothymosin), GFRA4 (GDNF receptor alpha-4), CDC42 (GTP-binding protein), EIF3H (translation initiation factor), UBE2D3 (ubiquitin-conjugating enzyme), and genes as described in, for example, She et al. (Definition, conservation and epigenetics of housekeeping and tissue-enriched genes. BMC Genomics. 2009 Jun. 17; 10:269.), and PCT/EP2011/051601.

The method according to the present invention generally identifies the quantitative cellular composition of a biological sample. Preferred is a method according to the present invention, wherein said biological sample is a sample of unknown cellular composition. Nevertheless, also samples of known cellular composition, or even partially known composition can be quantified.

Biological samples to be analyzed can be stored fresh-frozen, paraffin-embedded or Heparin, Citrate or EDTA-stabilized as cells in samples do not need to be intact. The present method is very robust and allows, in contrast to flow cytometry, a parallel, independent assessment of cell identity and quantity as well as sample composition. A very good correlation to FACS is provided, too.

The biological sample to be analyzed can be any sample comprising one or more type(s) of cells or that is suspected of comprising one or more type(s) of cells that are to be quantified. Preferred materials/biological samples are selected from a blood sample, in particular peripheral, capillary or venous blood samples, blood clots, or samples that are considered to contain blood cells as e.g. synovial fluid, lymph fluid, sputum, urine, tumor samples, as well as other fluid and tissue samples, histological preparations, DBS, artificially generated cells and mixtures thereof (e.g. cell culture samples).

Yet another aspect of the present invention then relates to a method according to the present invention, further comprising the step of concluding on the immune status of a mammal based on said epigenetic haemogram as produced.

Yet another aspect of the present invention then relates to a method according to the present invention, further comprising the step of monitoring said cellular composition in said biological sample as identified by comparing said composition and/or haemogram as identified with the composition in an earlier biological sample taken from the same mammal, and/or with the composition in a control sample. In this aspect, for example, modifications and changes of the cellular composition in a patient can be monitored during a medical treatment.

Yet another aspect of the present invention then relates to a method for diagnosing a disease or a predisposition for a disease, comprising a method according to the present invention as described above, and the step of concluding on the disease or a predisposition for said disease based on the cellular composition in said biological sample as identified. In this aspect, for example, modifications and changes of the cellular composition in a patient can be used for diagnosing a disease or a predisposition for a disease, in particular when the sample is compared to a sample of a healthy subject or to medical reference ranges. Preferably, said biological sample is a blood sample, in particular a whole or peripheral blood sample, and said cell-specific regions in the genome of cells in said sample are selected from regions specific for blood cell types. The disease to be diagnosed can be selected from the group consisting of immune diseases or conditions, transplant rejections, infection diseases, cancer, neurological diseases, allergy, primary and secondary immune deficiencies and hematologic malignancies such as, for example, lymphatic neoplasms, mature B-cell neoplasms, mature T- and NK-cell neoplasms, Hodgkin lymphomas, lympho-proliferative processes after transplantations, HIV and AIDS, Graft versus Host disease, rheumatoid arthritis, lupus erythematosus, breast cancer, colorectal cancer, esophageal cancer, stomach cancer, leukemia/lymphoma, lung cancer, prostate cancer, uterine cancer, skin cancer, endocrine cancer, kidney cancer, urinary cancer, pancreatic cancer, other gastrointestinal cancers, ovarian cancer, cervical cancer, head and neck cancer, adenomas, birth defects, myopathies, mental retardation, obesity, diabetes, gestational diabetes, multiple sclerosis, and asthma.

In one preferred embodiment of the present invention, the diagnostic use of the epigenetic haemogram is also based on the use of ratios of different populations and/or/to different subpopulations (subhaemograms) and/or/to of cells belonging to one subhaemogram according to the said epigenetic haemogram. Such ratios are e.g. but are not limited to, population of regulatory T cells in relation to $CD3^+$ T-lymphocytes, or regulatory T cells in relation to population of $CD4^+$ T-lymphocytes, or regulatory T cells in relation to population of $CD8^+$ T-lymphocytes, or $CD3^+$ T-lymphocytes to $CD4^+$ T-helper cells, or $CD3^+$ T-lymphocytes to $CD8^+$ cytotoxic T cells, or $CD4^+$ T-helper cells to $CD8^+$ cytotoxic T-cells, or Th1 to Th2, or Th1 to Th17, or Th2 to Th17, or memory or naïve $CD4^+$ T-helper cells to $CD3^+$ T-lymphocytes, or memory $CD8^+$ cytotoxic T-cells to $CD3^+$ T-lymphocytes, all as subpopulations of the T-lymphocytogram; or $CD3^+$ T-lymphocytes related to neutrophilic granulocytes, or macrophages to $CD4^+$ T-helper cells; $CD4^+$ T-lymphocytes related to neutrophilic granulocytes, or $CD8^+$ T-lymphocytes related to neutrophilic granulocytes all as relations between cells of different subhaemograms; or $CD3^-$ T-lymphocytes related to granulocytes, or B-lymphocytes to $CD3^+$ T-lymphocytes, or monocytes to CD3 T-lymphocytes, or monocytes to B-lymphocytes all as ratios out of populations of the leukocytogram; or $CD3^+$ T-lymphocytes or monocytes or B-lymphocytes, or granulocytes or NK cells related to overall leukocytes.

But also other ratios of subpopulations assessed according to the present invention and according to the epigenetic haemogram can be used as a diagnostic method. The disease can be selected from the group consisting of immune diseases or conditions, transplant rejections, infection diseases, cancer, neurological diseases, allergy, primary and secondary immune deficiencies and hematologic malignancies such as, for example, lymphatic neoplasms, mature B-cell neoplasms, mature T- and NK-cell neoplasms, Hodgkin lymphomas, lympho-proliferative processes after transplantations, HIV and AIDS, Graft versus Host disease, rheumatoid arthritis, lupus erythematosus, breast cancer, colorectal cancer, esophageal cancer, stomach cancer, leukemia/lymphoma, lung cancer, prostate cancer, uterine cancer, skin cancer, endocrine cancer, kidney cancer, urinary cancer, pancreatic cancer, other gastrointestinal cancers, ovarian cancer, cervical cancer, head and neck cancer, adenomas, birth defects, myopathies, mental retardation, obesity, diabetes, gestational diabetes, multiple sclerosis, and asthma. The diagnostic use encompasses but is not limited to the diagnosis of a disease and/or the follow-up of a disease and/or the predisposition for a disease and/or the monitoring of an effect of a chemical or biological substance.

The epigenetic haemogram of the invention is in another embodiment used for the assessment of the risk to develop a disease in a patient, therefore for diagnostic purposes. In one preferred embodiment of the present invention, the use of the epigenetic haemogram for the assessment of the risk to develop a disease is also based on the use of ratios of different populations and/or/to different subpopulations (subhaemograms) and/or/to of cells belonging to one subhaemogram according to the said epigenetic haemogram. Such ratios are e.g. but are not limited to, population of regulatory T cells in relation to $CD3^+$ T-lymphocytes, or regulatory T cells in relation to population of $CD4^+$ T-lymphocytes, or regulatory T cells in relation to population of $CD8^+$ T-lymphocytes, or $CD3^+$ T-lymphocytes to $CD4^+$ T-helper cells, or $CD3^+$ T-lymphocytes to $CD8^+$ cytotoxic T cells, or $CD4^+$ T-helper cells to $CD8^+$ cytotoxic T-cells, or Th1 to Th2, or Th1 to Th17, or Th2 to Th17, or memory or naïve $CD4^+$ T-helper cells to $CD3^+$ T-lymphocytes, or memory $CD8^+$ cytotoxic T-cells to $CD3^+$ T-lymphocytes, all as subpopulations of the T-lymphocytogram; or $CD3^+$ T-lymphocytes related to neutrophilic granulocytes, or macrophages to $CD4^+$ T-helper cells; $CD4^+$ T-lymphocytes related to neutrophilic granulocytes, or $CD8^+$ T-lymphocytes related to neutrophilic granulocytes all as relations between cells of different subhaemograms; or $CD3^+$ T-lymphocytes related to granulocytes, or B-lymphocytes to $CD3^+$ T-lymphocytes, or monocytes to $CD3^+$ T-lymphocytes, or monocytes to B-lymphocytes all as ratios out of populations of the leukocytogram; or $CD3^+$ T-lymphocytes or monocytes or B-lymphocytes, or granulocytes or NK cells related to overall leukocytes.

But also other ratios of subpopulations as assessed in accordance with the present invention and according to the epigenetic haemogram can be used to assess the risk for developing a disease. The disease for the herein described embodiment can be selected from the group consisting of immune diseases or conditions, transplant rejections, infection diseases, cancer, neurological diseases, allergy, primary and secondary immune deficiencies and hematologic malignancies such as, for example, lymphatic neoplasms, mature B-cell neoplasms, mature T- and NK-cell neoplasms, Hodgkin lymphomas, lympho-proliferative processes after transplantations, HIV and AIDS, Graft versus Host disease, rheumatoid arthritis, lupus erythematosus, breast cancer, colorectal cancer, esophageal cancer, stomach cancer, leukemia/lymphoma, lung cancer, prostate cancer, uterine cancer, skin cancer, endocrine cancer, kidney cancer, urinary cancer, pancreatic cancer, other gastrointestinal cancers, ovarian cancer, cervical cancer, head and neck cancer, adenomas, birth defects, myopathies, mental retardation, obesity, diabetes, gestational diabetes, multiple sclerosis, and asthma. The diagnostic use encompasses but is not limited to the diagnosis of a disease and/or the follow-up of a disease and/or the predisposition and/or the assessment of a risk for a disease and/or the monitoring of an effect of a chemical or biological substance.

As indicated, the above mentioned ratios as assessed in accordance with the present invention bear the potential to indicate e.g. the risk to develop a certain disease during the life time of a subject. A clinical role in risk assessment was found for the ratio of regulatory T-lymphocytes to CD3+ T-lymphocytes. Particularly preferred in the context of the present invention is that an increase in the ratio of regulatory T-lymphocytes to CD3+T-lymphocytes indicates a risk to develop cancer (cancerous disease) during life time. The cancer is selected from but not limited to the list as provided herein above, wherein a high impact of an increased ratio of regulatory T-lymphocytes to CD3+ T-lymphocytes is expected for the development of lung cancer, which is particularly preferred. Furthermore, ratios bear the potential to predict the development of Graft versus Host Disease wherein an increased ratio of regulatory T-lymphocytes to CD4+ T-lymphocytes within the first two weeks after stem cell transplantation predicts the development of a graft versus host disease.

Yet another aspect of the present invention then relates to a method for identifying the effect of a chemical or biological substance or drug on the composition of cells, comprising performing the method according to the present invention as described above, preferably on a blood sample obtained from a mammal treated with or exposed to said substance, and comparing the composition of cells in said sample with the composition of samples before treatment or with the composition of an untreated sample. The mammal to be treated with said chemical or biological substance or drug might be healthy or suffers from a disease selected from the group consisting of immune diseases or conditions, transplant rejections, infection diseases, cancer, neurological diseases, allergy, primary and secondary immune deficiencies and hematologic malignancies such as, for example, lymphatic neoplasms, mature B-cell neoplasms, mature T- and NK-cell neoplasms, Hodgkin lymphomas, lymphoproliferative processes after transplantations, HIV and AIDS, Graft versus Host disease, rheumatoid arthritis, lupus erythematosus, breast cancer, colorectal cancer, esophageal cancer, stomach cancer, leukemia/lymphoma, lung cancer, prostate cancer, uterine cancer, skin cancer, endocrine cancer, kid-kidney cancer, urinary cancer, pancreatic cancer, other gastrointestinal cancers, ovarian cancer, cervical cancer, head and neck cancer, adenomas, birth defects, myopathies, mental retardation, obesity, diabetes, gestational diabetes, multiple sclerosis, and asthma.

Yet another aspect of the present invention then relates to a diagnostic kit and its use, comprising materials for performing the method according to the invention as described herein, optionally with instructions for use. The diagnostic kit particularly contains oligonucleotides (e.g. for producing amplicons) specific for regions of interest, bisulfite reagents, and/or components for PCR. The diagnostic kit and its use encompasses but is not limited to the diagnosis of a disease and/or the follow-up of a disease and/or the predisposition and/or the assessment of a risk for a disease and/or the monitoring of an effect of a chemical or biological substance.

As mentioned above, currently, in both, clinical diagnostics and research, and drug development, a new method to provide a precise and comprehensive quantification of leukocytes and their subpopulations is desired even if biological samples are not intact anymore. The present invention, overcomes most problems of current, routinely used quantitative methods, flow cytometry and immune histochemistry, but more importantly, overcomes several biochemical and technical problems of qPCR in regard to absolute quantification of target cells. The present invention thus provides a method to effectively detect and quantify the different cell populations. In particular, the present method for the first time allows for an expression-independent method for the assessment of a comprehensive blood cell picture. Moreover, the present invention enables flexible time framing which is not dependent on quick sample processing but rather allows long term sample storage and individual coordination between sample collecting and sample processing.

The present invention will now be explained further in the following examples and figures, nevertheless, without being limited thereto. For the purposes of the present invention, all references as cited herein are incorporated by reference in their entireties.

FIG. 1 shows a schematic overview over the epigenetic haemogram. The haemogram comprises the leukocytogram, which includes B cells, monocytes, granulocytes, $CD3^+$ T-lymphocytes, and NK cells. Each subpopulation establishes an additional cytogram, respectively i.e. the B-lymphocytogram, monocytogram, granulocytogram, T-lymphocytogram, and NK cytogram. For these five sub-cytograms, the corresponding cell types are depicted. Each of these five sub-cytograms can be divided into additional subpopulations, e.g., the T cell cytogram can be further divided into the $CD4^+$ T-helper cytogram and the $CD8^+$ cytotoxogram.

Figure 2:
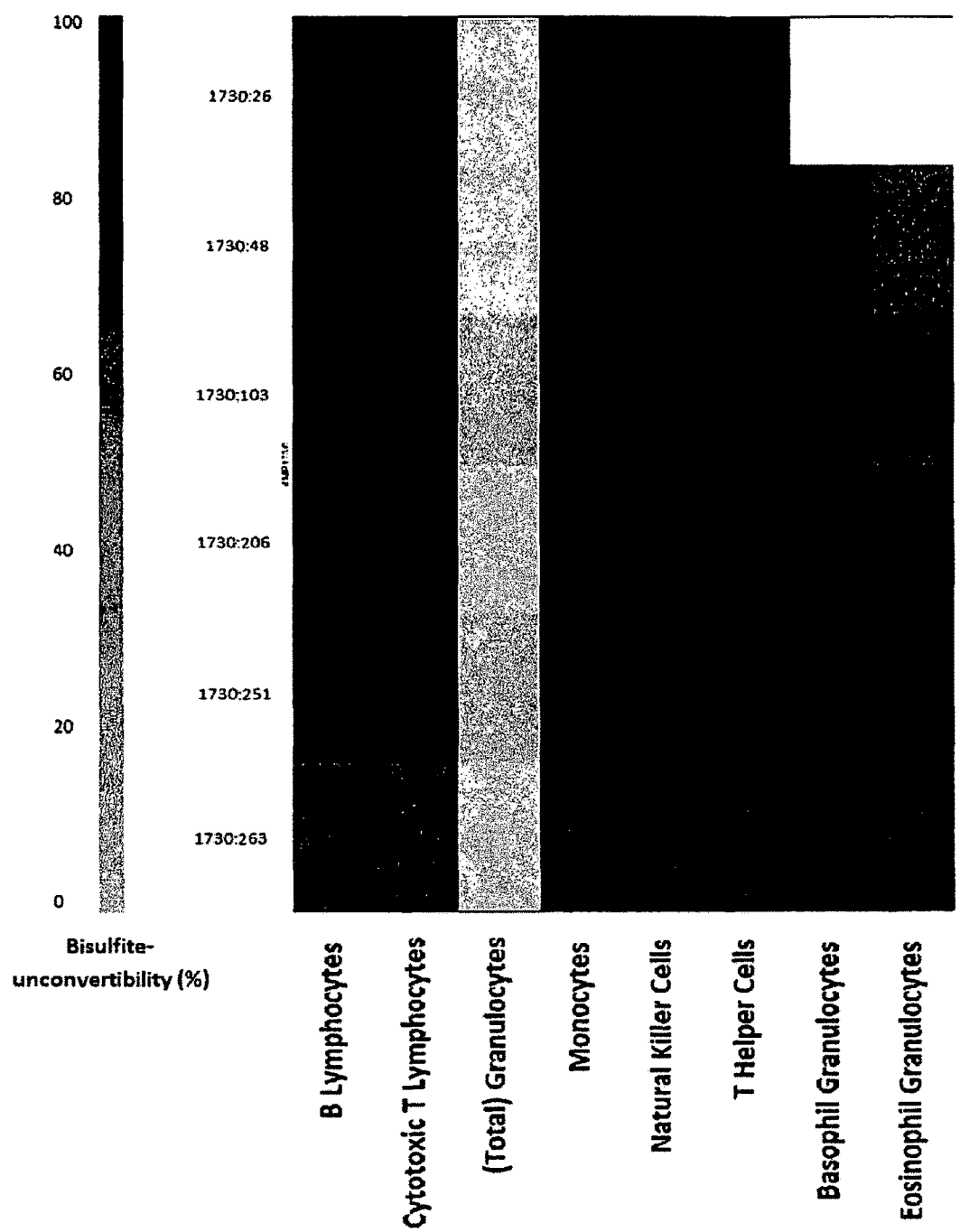

FIG. 2 shows a matrix indicating bisulfite-non-convertibility in cell-type specific genomic marker region. Different cell types were analyzed indicating that CpGs within genomic region AMP1730 are completely convertible by bisulfite treatment corresponding to 0% bisulfite-non-convertibility. The total fraction of granulocytes corresponds to neutrophilic granulocytes. Neutrophilic granulocytes account for about 90% of granulocytes, eosinophilic for about 7%, and basophilic for about 3% (see Example 4).

Figure 3:
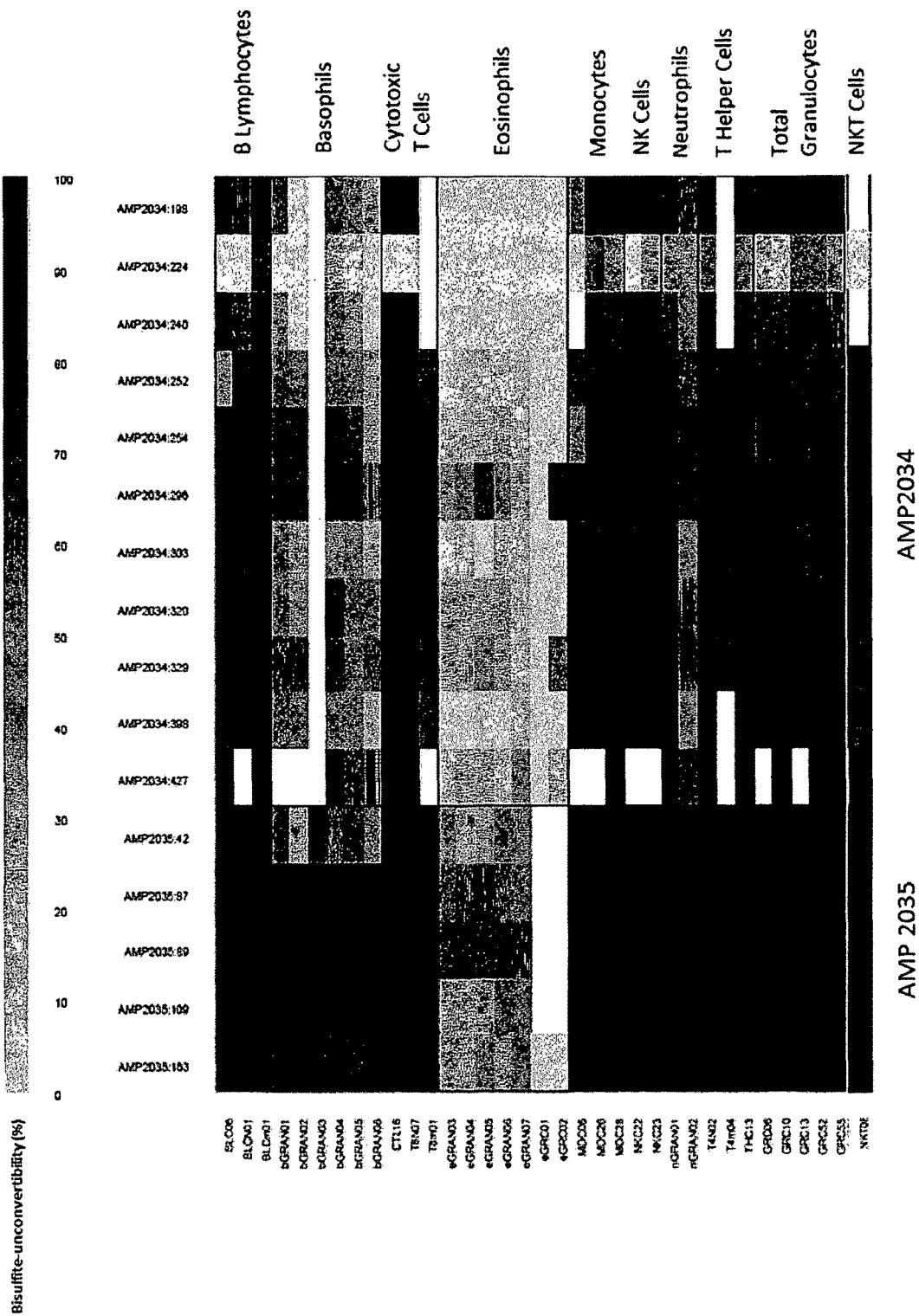

FIG. 3 shows a matrix indicating bisulfite-non-convertibility in cell-type specific genomic marker regions. Different cell types were analyzed indicating that CpGs within genomic region AMP2034 and 2035 are, in contrary to other cell types given, convertible by bisulfite to a high extent and indicative for this specific cell-type (see Example 5).

Figure 4:
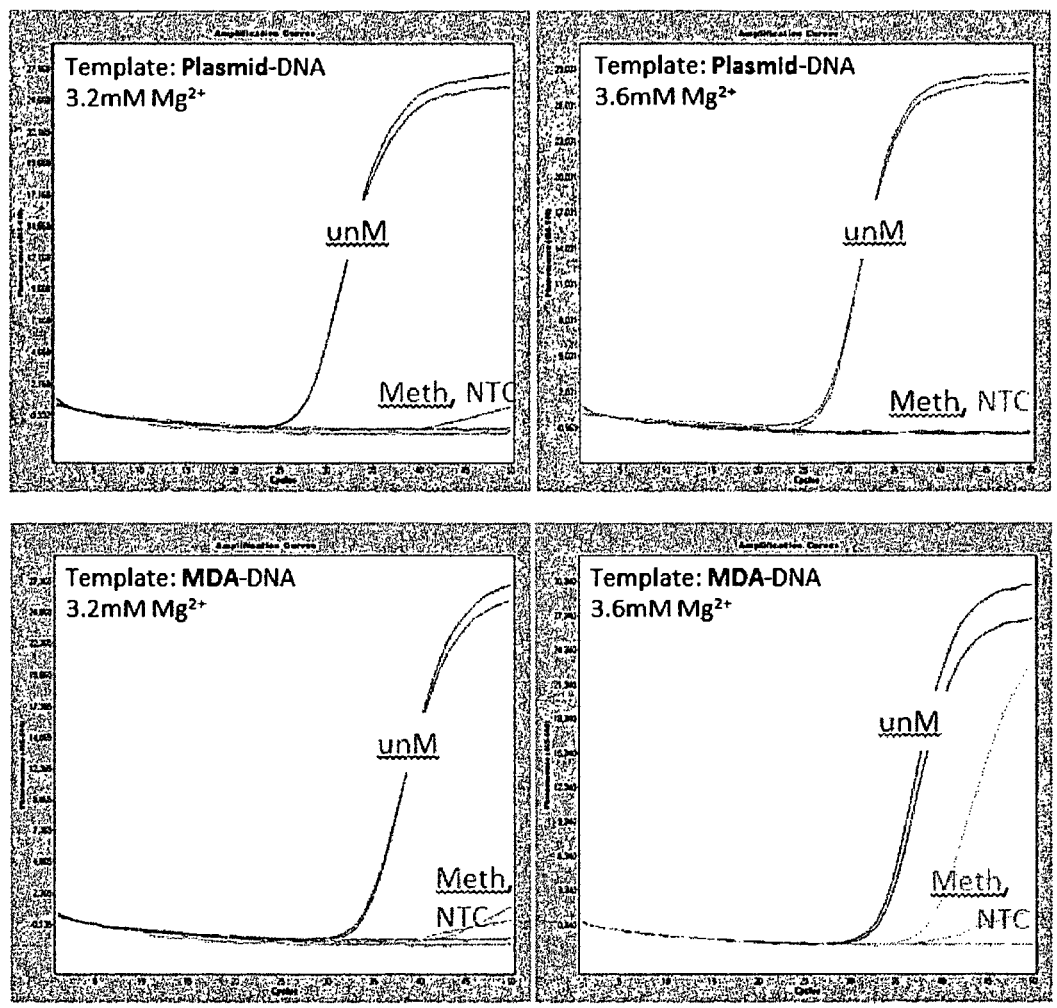

FIG. 4 shows the results of the test-template as amplified according to Example 7. unM (TpG Template): bisulfite-converted test-DNA; Meth (CpG template): non-bisulfite converted test-DNA; NTC: no template control; left panel: Mg2+ concentration 3.2 mM; right panel: Mg2+ concentration 3.6 mM.

SEQ ID No. 1 to 689 show sequences as used in the context of the present invention.

EXAMPLES

The present examples have been performed on a sample of known and unknown leukocyte and T-lymphocyte compositions. The person of skill will understand how to modify the experiments in order to identify and quantify other cell types, in particular blood cells in the context of an epigenetic haemogram, without undue burden and/or the need to become inventive.

Example 1—Assessment of Cell-Specific Assay-Correction Factors Using a Sample of Known Composition The inventors provided a human blood sample of known leukocyte and T-lymphocyte composition. The composition of this blood sample was analyzed via flow cytometry. The sample contained 61% granulocytes, 12% monocytes, 3% B-lymphocyte, 4% natural killer cells, and 19% T-lymphocytes (Table 5). The T cell population consisted of 13% of CD4+ T helper cells, 1.4% regulatory T cells, 5% CD8+ cytotoxic cells, and 2% naïve CD8+ cells.

In a next step, this sample of known leukocyte and T-lymphocyte composition was analyzed for the relative amount of bisulfite convertible chromatin in cell-type specific gene regions, resulting in a unique, discriminating cell-type specific pattern of bisulfite convertible chromatin, e.g. for granulocytes a region in the gene for neutrophil gelatinase-associated lipocalin, for monocytes a region in the leukocyte immunoglobulin-like receptor gene, for B cells in a region of the gene for the low-affinity receptor for IgE, for natural killer cells a region in the gene for oxysterol-binding protein-like protein 5 isoform a, for T-lymphocytesin a region in the CD3D/G gene, for CD4+ T helper cells in a region in the CD4 gene, for regulatory T cells in a region in the FOXP3 gene, for CD8+ cytotoxic T cells in a region in the CD8A/B gene, for naïve CD8+ cells a region in the endosialin gene. Analyses were performed by qPCR using a bisulfite-converted normalization standard indicating the relative amount of numbers of gene copies containing mentioned unique, said cell-type specific pattern of bisulfite convertibility. These relative numbers of cell-specific gene copies indicate the relative amount of said specific cells.

This relative number of specific cells (said leukocytes and T-lymphocytes) was compared with the result of flow cytometry. Both results were set in relation, and a correction factor was determined (Table 1). Flow cytometry revealed 61% and qPCR 91.6% of granulocytes, and therefore the cell-specific granulocyte assay-correction factor was 1.502.

Correction factors were determined separately for each set of assessments as well as are incorporated into data base for assay-specific correction factors. In addition to the individual and separate determination of correction factors (for each set of assessments), the average of past correction factors can be used as well.

TABLE 5

Assessment of cell-specific assay-correction factors. Cell composition of human blood sample was assessed by flow cytometry and qPCR for leukocytes as well as T-lymphocytes. qPCR was performed using a bisulfite-converted normalizations standard. Correction factors for following qPCRs on samples of unknown composition were determined by ratio of qPCR/FC. (C-Factor) correction factor, (FC) Flow cytometry, (GRK01) internal sample number. (qPCR) real time quantitative polymerase chain reaction.

| | FC GRK01 (%) | qPCR GRK01 | C-Factor |
|---|---|---|---|
| Leukocytogram | | | |
| granulozytes | 61.0 | 91.6 | 1.502 |
| monozytes | 12.0 | 29.9 | 2.494 |
| B cells | 3.0 | 1.3 | 0.429 |
| natural killer cells | 4.0 | 3.9 | 0.977 |
| T cells | 19.0 | 29.8 | 1.568 |
| T-Lymphocytogram | | | |
| CD4+ T helper cells | 13.0 | 9.7 | 0.745 |
| regulatory T cells | 1.4. | 2.3 | 1.668 |
| CD8+ cytotoxix T cells | 5.0 | 8.0 | 1.594 |
| naive CD8+ cells | 2.0 | 2.1 | 1.051 |

Example 2—Assessment of Absolute Cell Composition in an Unknown Blood Sample of Healthy Volunteers Using an Assay-Correction Factor Determined Using a Sample of Known Composition (as Shown in Example 1)

Human blood samples of unknown leukocyte and T-lymphocyte composition of healthy volunteers were obtained for assessment of absolute leukocyte and T-lymphocyte composition via qPCR. As for Example 1, DNA of blood samples were isolated, bisulfite converted and relative amount of bisulfite converted DNA assessed via qPCR under the use of Bisulfite-converted normalization standards. Amount of bisulfite convertible DNA in cell-specific gene regions was set in relation to bisulfite-convertible DNA of cell-unspecific DNA region (always, cell independent, constant pattern of bisulfite-convertibility) to obtain relative amount of assessed cells.

Cell-specific assay-correction factors were determined in a parallel experimental set for assays of granulocytes, monocytes, B-lymphocytes, natural killer cells, T-lymphocytes, CD4+ T helper cells, regulatory T cells, and CD8+ cytotoxic T cells using flow cytometry on a human blood sample (methodology see example 1, human blood sample differs for Example 2 compared to Example 1). Relative amounts of assessed cells as obtained were corrected using the cell-specific assay correction factors. E.g., qPCR for monocytes patient sample S04 gave a relative amount of monocytes of 7.94%, but the correction revealed an absolute cell amount of 3.69% monocytes.

One would expect the sum of cells belonging to a leukocytogram to be 100%, and the sum of cells belonging to a T-lymphocytogram to have exactly the same amount of cells as determined for T-lymphocytes in the leukocytogram. It is known that even the flow cytometry quantification is not without limitations, as described above.

TABLE 6

Assessment of absolute cell composition of blood from healthy volunteers. Cell composition of human blood samples were assessed by qPCR for leukocytes as well as T-lymphocytes. qPCR was performed using a bisulfite-converted normalizations standard. Correction factors for qPCRs were determined in a parallel set of experiments (not described in detail here, example of assessment of C-Factor see Example 1). (C-Factor) correction factor, (FC) Flow cytometry, (S04)(S08) internal sample numbers. (qPCR) real time quantitative polymerase chain reaction.

Leukocytogram (% relative cell amount)

|  | qPCR-S04 | qPCR-S08 |
|---|---|---|
| granulozytes | 79.74 | 81.29 |
| monozytes | 7.94 | 11.05 |
| B cells | 1.63 | 1.68 |
| natural killer cells | 2.74 | 2.04 |
| T cells | 23.25 | 22.09 |

Leukocytogram (% absolute cell amount)

|  | C-Factor | qPCR-S04 | qPCR-S08 |
|---|---|---|---|
| granulozytes | 1.23 | 64.74 | 65.99 |
| monozytes | 2.15 | 3.69 | 5.13 |
| B cells | 0.39 | 4.13 | 4.26 |
| natural killer cells | 0.97 | 2.88 | 2.11 |
| T cells | 1.54 | 19.27 | 18.31 |
| Sum |  | 94.71 | 95.8 |

T-Lymphocytogram (% relative cell amount)

|  | qPCR-S04 | qPCR-S08 |
|---|---|---|
| CD4+ T helper cells | 5.89 | 5.11 |
| regulatory T cells | 1.67 | 1.15 |
| CD8+ cytotoxix T cells | 5.26 | 3.80 |

T-Lymphocytogram (% absolute cell amount)

|  | C-Factor | qPCR-S04 | qPCR-S08 |
|---|---|---|---|
| CD4+ T helper cells | 0.45 | 13.16 | 11.42 |
| regulatory T cells | 1.1 | 1.52 | 1.05 |
| CD8+ cytotoxix T cells | 1.09 | 4.85 | 3.5 |
| Sum |  | 19.53 | 15.97 |

Flow cytometry measurement errors are reflected in qPCR corrections. On the other hand, the epigenetics based qPCR, as described herein, detected cell types independently of marker expression. Even if a cell-specific marker is expressed at a very low amount, or is not present at all, epigenetic-qPCR can detect these cells (e.g. as found for Th17 cells, see above). In addition, certain cells do express cell-specific markers, even if these cells did not enter a specific cellular state known to be associated with the marker expression (e.g. as found for regulatory T cells, see description above). Such cells are not detected by epigenetic-based qPCR. Additionally, for this example, the selection of T-lymphocytes (CD4+ T helper cells, CD8+ cytotoxic cells) does not represent the complete T-lymphocyte set (see FIG. 1). Cytograms represent the current status of scientific knowledge and cannot exclude the existence of additional cell types or of the incorrect definition of subpopulations thereof.

Example 3—Assessment of Absolute Cell Composition in an Unknown Blood Sample of Auto-Immune Diseased Volunteers Using an Assay-Correction Factor Determined Using a Sample of Known Composition (as Shown in Example 1)

Human blood samples of unknown leukocyte and T-lymphocyte composition of auto-immune diseased volunteers were obtained for assessment of absolute leukocyte and T-lymphocyte composition via qPCR. As for Example 1, DNA of blood samples were isolated, bisulfite converted and relative amount of bisulfite converted DNA assessed via qPCR. Amount of bisulfite convertible DNA in cell-specific gene regions was set in relation to bisulfite convertible DNA of cell-unspecific DNA region (always, cell independent, constant pattern of bisulfite convertibility) to obtain relative amount of assessed cells.

Cell-specific assay-correction factors were determined in a parallel experimental set for assays of granulocytes, monocytes, B-lymphocytes, natural killer cells, T-lymphocytes, CD4+ T helper cells, regulatory T cells, and CD8+ cytotoxic T cells using flow cytometry on a human blood sample (methodology see example 1, human blood sample differs for Example 3 compared to Example 1). Obtained relative amounts of assessed cells were corrected using these cell-specific assay correction factors. E.g., qPCR for T-lymphocytes assessed a relative amount of T-lymphocytes of 8.49% for patient M06 and 23.94% for patient M10. Correction revealed an absolute cell amount of 5.4% and 15.3% T cells, respectively.

In comparison to data from healthy patients, see Example 2, for auto-immune diseased patient M06 an obvious decrease in 4 of the 5 subtypes of leukocytes within the leukocytogram was observed. For patient M10 an obvious decrease in absolute number of only B-lymphocytes and monocytes was observed.

Additionally, also for T-lymphocyte subtypes, differences between both patients were observed. qPCR analysis of three subtypes of T-lymphocytes for patient M06 revealed a strong decrease of CD4+ T helper cells as well as CD8+ cytotoxic cells whereas the decrease in level of regulatory T cells was less pronounced. For patient M10 all three cell levels decreased simultaneously by about 50-60% compared to the average of the two healthy patients in Example 2.

All these differences might be related to e.g. a different medication and/or disease stage of these both patients and offer a clinical routine instrument for disease diagnosis, prediction as well as accompanying monitoring.

TABLE 8

Assessment of absolute cell composition of blood from auto-immune diseased patients. Cell composition of human blood samples were assessed by qPCR for leukocytes as well as T-lymphocytes. qPCR was performed using a bisulfite-converted normalizations standard. An obvious decrease of the level of certain cell populations was seen that is known for auto immune diseases. Correction factors for qPCRs were determined in a parallel set of experiments (not described in detail here, example of assessment of C-Factor see Example 1). (C-Factor) correction factor, (FC) Flow cytometry, (S04)(S08) internal sample numbers. (qPCR) real time quantitative polymerase chain reaction.

Leukocytogram (% relative cell amount)

|  | qPCR-M06 | qPCR-M10 |
|---|---|---|
| granulozytes | 126.62 | 116.26 |
| monozytes | 3.12 | 3.36 |
| B cells | 0.21 | 0.72 |

TABLE 8-continued

Assessment of absolute cell composition of blood from auto-immune diseased patients. Cell composition of human blood samples were assessed by qPCR for leukocytes as well as T-lymphocytes. qPCR was performed using a bisulfite-converted normalizations standard. An obvious decrease of the level of certain cell populations was seen that is known for auto immune diseases. Correction factors for qPCRs were determined in a parallel set of experiments (not described in detail here, example of assessment of C-Factor see Example 1). (C-Factor) correction factor, (FC) Flow cytometry, (S04)(S08) internal sample numbers. (qPCR) real time quantitative polymerase chain reaction.

| | | |
|---|---|---|
| natural killer cells | 0.51 | 2.76 |
| T cells | 8.49 | 23.94 |

Leukocytogram (% absolute cell amount)

| | C-Factor | qPCR-M06 | qPCR-M10 |
|---|---|---|---|
| granulozytes | 1.50 | 84.3 | 77.4 |
| monozytes | 2.49 | 1.3 | 1.3 |
| B cells | 0.43 | 0.5 | 1.7 |
| natural killer cells | 0.98 | 0.5 | 2.8 |
| T cells | 1.57 | 5.4 | 15.3 |
| Sum | | 92.0 | 98.5 |

T-Lymphocytogram (% relative cell amount)

| | qPCR-M06 | qPCR-M10 |
|---|---|---|
| CD4+ T helper cells | 1.97 | 6.35 |
| regulatory T cells | 1.58 | 0.97 |
| CD8+ cytotoxix T cells | 2.09 | 3.35 |

T-Lymphocytogram (% absolute cell amount)

| | C-Factor | qPCR-M06 | qPCR-M10 |
|---|---|---|---|
| CD4+ T helper cells | 0.7 | 2.6 | 8.5 |
| regulatory T cells | 1.7 | 0.9 | 0.6 |
| CD8+ cytotoxix T cells | 1.6 | 1.3 | 2.1 |
| Sum | | 4.8 | 11.2 |

Example 4—Detection of Neutrophilic Granulocytes Based on AMP1730 in the Gene for Neutrophil Gelatinase-Associated Lipocalin (LCN2) (See FIG. 2)

FIG. 2 shows a matrix indicating bisulfite-unconvertibility in cell-type specific genomic marker region. Different cell types were analyzed indicating that CpGs within genomic region AMP1730 are completely convertible by bisulfite treatment corresponding to 0% bisulfite-unconvertibility. Within basophil and eosinophil granulocytes specific CpGs of AMP1730 are not convertible by bisulfite. Therefore, the term "(Total) Granulocytes"" within figure corresponds to neutrophilic granulocytes. Neutrophilic granulocytes account for about 90% of granulocytes, eosinophilic for about 7%, and basophilic for about 3%.

AMP1730—Neutrophilic Granulocytes Assay

TABLE 7

Discriminatory quality of AMP1730: qPCR using assay specific primers for AMP1730 was performed on cells indicated under "sample" to analyze amount of bisulfite-convertibility of CpGs present in genomic region given by AMP1730. DNA from purified cell samples was isolated, bisulfite treated and qPCR assay performed under the use of a bisulfite-converted normalization standard. Relative amount of cells was assessed via comparing copy numbers of busulfite-convertible DNA of AMP1730 with bisulfite-unconvertible DNA of AMP1730, named "TpG/CpG-System". (copy numer convertible/(copy number convertible + copy number non-convertible) = % cell type). Cells were purified and sorted via flow cytometry. Within the neutrophiles cell sample, more than 95% of the cells were detected as neutrohiles using AMP1730. (bGRAN) basophiles, (eGRAN) eosinophiles (nGRAN) neutrophiles, (MOC) monocytes, (THC) CD3+CD4+ T-lymphocyets, (CTL) cytotoxic CD3+CD8+ T-lymphocytes, (NKC) CD3− natural killer cells, (NKT) CD3+ natural killer cells, (BLC) B-lymphocytes.

AMP1730 - neutrophilic granulocytes assay

| | PCR-System specific to "TpG" | | PCR-System specific to "CpG" | | |
|---|---|---|---|---|---|
| Sample | CP Value | copy numbers acc. To plasmid units | CP Value | copy numbers acc. To plasmid units | % nGRC 'TpG" variant |
| bGRAN | 35.49 | 14.27 | 29.09 | 875.33 | 1.60 |
| eGRAN | 25.24 | 16.20 | 30.68 | 300.00 | 5.12 |
| nGRAN | 30.52 | 270.67 | 35.73 | 11.70 | 95.86 |
| MOC | 35.72 | 12.93 | 29.85 | 525.00 | 2.40 |
| THC | 42.70 | 0.91 | 30.80 | 278.00 | 0.33 |
| CTL | 37.72 | 5.04 | 29.41 | 706.00 | 0.71 |
| NKC | 36.95 | 7.03 | 29.34 | 740.33 | 0.94 |
| NKT | 38.35 | 3.85 | 30.37 | 369.67 | 1.03 |
| BLC | 39.75 | 2.41 | 29.91 | 502.67 | 0.48 |

Example 5—Detection of Eosinophilic Granulocytes Based on AMP 2034 and/or 2035 (PRG2)

Matrix indicating bisulfite-inconvertibility in cell-type specific genomic marker regions. Different cell types were analyzed indicating that CpGs within genomic region AMP2034 and 2035 are, in contrary to other cell types given, convertible by bisulfite to a high extent and indicative for this specific cell-type (see FIG. 3).

Example 6—Assessment of Cell-Specific Assay-Correction Factor Using a Non-Bisulfite-Converted Nucleic Acid Molecule (Plasmid Standard) as Normalization Standard The inventors developed non-bisulfite converted, genomic plasmid standards as a normalization standard. One of these genomic plasmid standards comprises marker regions being specific for stable regulatory T cells (TSDR region)(Treg cells) as well as marker regions being cell-type unspecific (GAPDH, housekeeping gene, detecting all cells, 100% of cells). This plasmid standard is used to determine the Treg-specific assay correction factor that allows assessing the absolute amount of stable Tregs within an unknown blood sample.

In a first step, a human blood sample of unknown composition was provided, DNA isolated, and bisulfite treated. Following, the amount of bisulfite converted TSDR copies and GAPDH copies were assessed (Table 8, section 2). These qPCR analyses were performed using a bisulfite-converted normalization standard (Table 8, section 1) indicating the number of bisulfite-converted DNA copies containing the TSDR marker region as well as the GAPDH marker region (Table 8 section 2). The relative amount of stable Tregs is calculated as number of bisulfite converted TSDR copies related to bisulfite converted GAPDH copies in percent.

no. bisulfite-converted *TSDR* copies/no. bisulfite-converted *GAPDH* copies×100=% Treg 67.70/6026.67×100=1.123%

The cell-type specific region for stable regulatory T cells, TSDR, is located on the X-chromosome. For women an epigenetic silencing of one allele of the X-chromosome is known. This affect is deduced by using a factor 2 when calculating relative amount of stable Tregs (final result=2.25% stable Tregs) (Table 8, section 2).

In a second step, Treg-specific assay-correction factor based on said genomic plasmid standard was assessed. Said plasmid standard was bisulfite converted and number of plasmid copies assessed by qPCR using primers specific for bisulfite-converted marker regions for Treg cells and for GAPDH. These qPCR analyses were also performed using the bisulfite-converted normalization standard (Table 8, section 1). The efficiency of qPCR for Treg cells and GAPDH should be equal as the novel genomic, non-bisulfite converted plasmid standard (the substrate) contains an equimolar amount of Treg cell-specific and GAPDH-specific genomic copies. Therefore, assessed deviation of Treg copy numbers from GAPDH copy numbers corresponds to differences in assay efficiencies.

Treg (*TSDR*) copy numbers=6760 vs. *GAPDH* copy numbers=6273,33

This deviation defines the cell-type assay-specific correction factor. E.g.:

Treg (*TSDR*) copy numbers/*GAPDH* copy numbers/100=6760/6273.33=1.077.

For Treg cells an assay correction factor of 1.1 (average, n=3) was assessed (Table 8, section 3). Correcting the relative amount of Treg cells by factor 1.1 results in an absolute amount of 2.05% Treg cells within the unknown blood sample WB01.

relative amount of Treg cells/specific assay-correction factor=absolute amount of Treg 2.25%/1.1=2.05% Treg cells

TABLE 8

Assessment of Treg-specific assay-correction factor using a bisulfite-unconverted nucleic acid molecule as a plasmid standard.
qPCR1 (FOXP3 TSDR) Assay Run-ID: 115_genomSTD_NormalizationFactorTreg 1) qPCR for bisulfite-converted normalization standard:

| Standards for Quantification | | qPCR for TSDR bisulfite-converted normalization standard | | qPCR for GAPDH bisulfite-convered normalization standard | |
|---|---|---|---|---|---|
| Standard-ID | Plasmid Units | CP Value | copy numbers normalization standard | CP Value | copy numbers normalization standard |
| Standard-1 | 31250 units | 23.18 | 31500.00 | 23.10 | 32766.67 |
| Standard-2 | 6250 units | 25.55 | 6150.00 | 25.49 | 6010.00 |
| Standard-3 | 1250 units | 27.86 | 1250.00 | 27.71 | 1243.33 |
| Standard-4 | 250 units | 30.20 | 249.00 | 29.91 | 260.00 |
| Standard-5 | 50 units | 32.86 | 53.00 | 32.78 | 44.13 |
| Standard-6 | 30 units | 34.05 | 31.80 | 33.36 | 32.70 |

2) qPCR on blood sample of unknow composition for assessment of relative amount of Treg cells using the bisulfite-converted normalization standard as given under 1):

| Sample ID unknown blood sample | gender | qPCR for TSDR bisulfite converted DNA | | qPCR for GAPDH bisulfite converted DNA | | relative amount stable Treg |
|---|---|---|---|---|---|---|
| | | CP Value | copy numbers acc. to normalization standard (1) | CP Value | copy numbers acc. to normalization standard (1) | |
| WB01 | female | 32.38 | 67.70 | 25.49 | 6026.67 | 2.25% |

3) qPCR on genomic plasmid standard for assessment of Treg-specific correction factor

| Sample ID genomic standard | dilution genom. standard | qPCR for TSDR bisulfite converted DNA | | qPCR for GAPDH bisulfite converted DNA | | % stable Treg/GAPDH genomic plasmid units |
|---|---|---|---|---|---|---|
| | | CP Value | copy numbers acc. to normalization standard (1) | CP Value | copy numbers acc. to normalization standard (1) | |
| GP5000 | 1 | 25.41 | 6760.00 | 25.44 | 6273.33 | 107.76 |
| GP1000 | 1:5 | 27.71 | 1380.00 | 27.75 | 1206.67 | 114.36 |

TABLE 8-continued

Assessment of Treg-specific assay-correction factor using a bisulfite-unconverted
nucleic acid molecule as a plasmid standard.
qPCR1 (FOXP3 TSDR) Assay Run-ID: 115_genomSTD_NormalizationFactorTreg

| GP200 | 1:25 | 29.93 | 301.00 | 29.82 | 278.00 | 108.27 |
|---|---|---|---|---|---|---|
| | | | | | | Mean: 110.13 |
| | | | | | | Normalization Factor: 1.10 |

4) Correction of relative amount of Tregs using Treg-specific correction factor to obtain absolute amount of Treg cells

| Treg relative amount | Normalization Factor | Treg absolute amount |
|---|---|---|
| 2.25% | 1.1 | 2.05% |

Example 7—Development of Cell-Specific qPCR Assay for Detection and Discrimination of Neutrophil Granulocytes Detecting Cell-Type Specific, Differential Bisulfite Convertibility:

DNA from the purified neutrophil granulocytes (neutrophils), monocytes, CD4+ cells CD8+ cells, B cells, NK-cells, and NKT cells was bisulfite-treated and bisulfite converted DNA analyzed at various CpG dinucleotide motifs. The inventors then compared the bisulfite convertibility (finding C as for Cytosine that was methylated in the original (genomic) sequence versus T for cytosine that was unmethylated in the original sequence) of these CpG dinucleotides (see Table 4, position 259).

Surprisingly, it was found that specific areas in the genomic region of lipocalin-2 were differentially methylated in neutrophil granulocytes compared to all other blood cell types tested. These areas were defined as discovery fragments, such as e.g. SEQ ID 517 for neutrophils (Table 4, position 259).

Validation of Bisulfite Convertibility:

Then, upon finding of the differential bisulfite convertibility, the inventors analyzed larger genomic regions by means of bisulfite sequencing. This latter procedure served for exploring and extending the discovered, differentially methylated areas and was conducted, for example with the differentially bisulfite converted discovery fragment, SEQ ID 517, within the gene lipocalin-2 as disclosed herein (see Table 4, SEQ ID 517 discovery fragment and 518 discriminative region of interest (ROI)).

Within the discriminative ROI defined as SEQ ID 518 a preferred region of interest including preferable CpG positions to be analyzed was identified (amplicon (AMP) 1730, see FIG. 2 and SEQ ID 685).

Development of Cell-Type Specific qPCR Assay:

In AMP 1730, a detailed analysis was performed in order to develop a highly specific qPCR assay based on the use of amplification primers and probes. Amplification primers (forward and reverse) for bisulfite converted neutrophils specific AMP 1730 as well as probes were designed and tested (data not shown).

In order to develop a particularly preferred "perfect" primer system for the assay, primers were developed that do not correspond 100% to the original bisulfite converted sequence but include specific mismatches that surprisingly increased the specificity. Mismatches in the primer sequence are underlined and bold.

TpG System (Detecting TpG Positions in Bisulfite-Converted DNA):

```
Forward Primer:
q1730 nm2Fw2_M1:
ACCAAAAATACAACACTTCAA;

Reverse Primer:
q1730 nm2R2:
GGTAATTGTTAGTAATTTTTGTG;

Hydrolysis Probe:
q1730 nm2P4:
FAM-CACTCTCCCCATCCCTCTATC-BHQ1.
```

CpG System (Detecting CpG Positions in Bisulfite-Converted DNA):

```
Forward Primer:
q1730_m2F1:
TACCAAAAATACAACACTCCG

Reverse Primer:
q1730_m2R2_M1:
AGGTAATTGTTAGTAATTTTTACG

Hydrolysis Probe:
q1730 m2P1:
HEX-CTCACTCTCCCCGTCCCTCTATC-BHQ1
```

The technical specificity of the TpG-specific PCR-system was tested based on test-templates (see FIG. 4). TpG and the CpG specific PCR system were found to be highly specific for the bisulfite converted and the non-bisulfite converted template, respectively. Additionally, the TpG-specific and CpG-specific PCR system show no cross reactivity with the CpG and the TpG templates, respectively (FIG. 4 shown for TpG-specific PCR system). In order to further increase specificity of the qPCR primer system, Mg2+ concentration was increased from 3.2 mM (usually applied) to 3.5 mM (see FIG. 4).

The biological specificity of the neutrophils-specific qPCR-system was tested using certain sorted cell fractions as well as using whole blood samples (see Table 9). The established qPCR assay was found to be highly specific for neutrophils.

TABLE 9 summarizes the results of the qPCR-analysis of sorted immune cells and whole blood samples. Shown are the CP-values for plasmid standards, for immune cell types and whole blood samples, each for the bisulfite converted, neutrophil-specific marker copies (TpG PCR-system) and the non-bisulfite converted, neutrophil-specific marker copies (CpG PCR-system) system. Based on the plasmid standard the corresponding copy numbers (plasmid copies) were calculated from the CP-value as measured. (NTC) no template control; (nGRC) neutrophil granulocytes.
q1730* (nGRC) Assay    Run-ID: UBq1730_b_BSCT-Valid.
qPCR for bisulfite-converted normalization standard:

| Standards for Quantification | | qPCR for nGRC bisulfite-converted normalization standard (TpG) | | qPCR for nGRC non-bisulfite-converted normalization standard (CpG) | |
|---|---|---|---|---|---|
| Standard-ID | Plasmid Units | CP Value | Plasmid Units | CP Value | Plasmid Units |
| Standard-1 | 31250 units | 23.5 | 30433.3 | 23.8 | 30766.7 |
| Standard-2 | 6250 units | 25.8 | 6340.0 | 26.2 | 6300.0 |
| Standard-3 | 1250 units | 28.2 | 1316.7 | 28.6 | 1240.0 |
| Standard-4 | 250 units | 30.6 | 257.7 | 30.9 | 256.0 |
| Standard-5 | 50 units | 32.8 | 62.2 | 33.1 | 60.5 |
| Standard-6 | 30 units | | | | |
| NTC | NTC | ND | ND | ND | ND |

| Analyzed Samples | | PCR-System specific to "TpG" | | PCR-System specific to "CpG" | | % nGRC |
|---|---|---|---|---|---|---|
| Epionts-ID | Cell Type | CP Value | Plasmid units | CP Value | Plasmid units | 'TpG"/"CpG" |
| bGRAN06 | Basophila | 35.49 | 14.27 | 29.09 | 875.33 | 1.60 |
| eGRAN09 | Eosinophila | 35.24 | 16.20 | 30.68 | 300.00 | 5.12 |
| nGRAN02 | Neutrophils | 30.52 | 270.67 | 35.73 | 11.70 | 95.86 |
| MOC28 | Monocytes | 35.72 | 12.93 | 29.85 | 525.00 | 2.40 |
| THC14 | T-helper cells | 42.70 | 0.91 | 30.80 | 278.00 | 0.33 |
| CTL16 | Cyototox. T-cells | 37.72 | 5.04 | 29.41 | 706.00 | 0.71 |
| NKC_Pool | NK Cells | 36.95 | 7.03 | 29.34 | 740.33 | 0.94 |
| NKT19 | NK T-cells | 38.35 | 3.85 | 30.37 | 369.67 | 1.03 |
| BLC06 | B-Lymphocytes | 39.57 | 2.41 | 29.91 | 502.67 | 0.48 |
| WBL51 | Whole Blood | 30.61 | 253.67 | 31.69 | 152.67 | 62.43 |
| WBL55 | Whole Blood | 29.43 | 561.00 | 30.84 | 268.67 | 67.62 |
| WBL57 | Whole Blood | 31.59 | 134.00 | 32.08 | 117.67 | 53.25 |
| WBL58 | Whole Blood | 31.94 | 107.33 | 31.68 | 154.33 | 41.02 |

The relative amount of neutrophils in the sample is calculated from the number of bisulfite converted, neutrophil-specific marker copies and the sum of bisulfite converted and non-bisulfite converted neutrophil-specific marker copies in the sample as follows:

% neutrophils=no. of bisulfite converted neutrophil copies/no. of non-bisulfite converted neutrophil copies×100;

% neutrophils=253.67/(253.67+152.67)×100=62.43

The present assay is special in the sense that the amplification of the bisulfite-converted neutrophils-target-DNA using "common" fitted primers and standard PCR-protocols does not provide a sufficient result. Only after using amplification primers that were designed having a mutation (a "mismatch") at strategic sites as identified herein, together with the use of a much higher $Mg^{2+}$-concentration in the PCR allows for the efficient amplification of the neutrophils-target region.

In a next step a genomic plasmid standard can be designed and cell-specific assay-correction factor can be assessed (see Example 6).

Example 8—Assessment of Cell-Specific Assay-Correction Factor Using a Non-Bisulfite-Converted Nucleic Acid Molecule (Genomic Plasmid Standard) as Normalization Standard to Quantify Absolute Number of Cells Per Microliter The inventors developed non-bisulfite converted, genomic plasmid standards as a normalization standard. One of these genomic plasmid standards comprises a marker region being specific for T-lymphocytes as well as a marker region being cell-type unspecific (GAPDH, housekeeping gene, detecting all cells, 100% of cells). Each single plasmid contains the same number of copies of these two marker regions (equimolar); two of these plasmids correspond to the number of DNA copies per one single immune cell and are therefore counted as one single cell. A stock solution containing defined numbers of said genomic plasmid molecules is used to determine the T-lymphocyte-specific assay-correction factor as well as to assess the absolute number of T-lymphocytes per microliter within an unknown blood sample.

In a first step, DNA of four human blood samples of unknown composition was isolated. This isolated DNA as well as the genomic plasmids of genomic plasmid standard were bisulfite treated. Following, the amount of copies of bisulfite converted T-lymphocyte-specific and GAPDH-specific marker regions were assessed by qPCR (Table 10, section B, C). These qPCR analyses were performed using a bisulfite-converted normalization standard (Table 10, section A) indicating the relative number of bisulfite-converted DNA as well as relative number of genomic plasmid copies containing the T-lymphocyte-specific marker region and the GAPDH marker region (Table 10 section B, C).

The relative amount of T-lymphocytes in percent within unknown blood samples is calculated as number of bisulfite converted T-lymphocyte-specific marker copies related to bisulfite converted GAPDH copies (Table 10, section B).

$$\% \text{ T-lymphocytes} = \frac{no.\ \text{bisulfite-converted T-lymphocyte-specific marker copies} \times 100}{no.\ \text{bisulfite-converted GAPDH copies}}$$

(e.g. RD260314): $1896.7/6570.0 \times 100 = 28.87\%$

In a next step, T-lymphocyte-specific assay-correction factor based on said genomic plasmid standard was assessed (Table GR, section C). As described above, said genomic plasmid standard was bisulfite converted and number of plasmid copies assessed by qPCR using primers specific for bisulfite-converted marker regions for T-lymphocytes and for GAPDH. These qPCR analyses were also performed using the bisulfite-converted normalization standard (Table 10, section A). The efficiency of qPCR for T-lymphocytes and GAPDH should be equal as the novel genomic, non-bisulfite converted plasmid standard contains an equimolar amount of copies T-lymphocyte-specific and GAPDH-specific marker regions. Therefore, assessed deviation of genomic T-lymphocyte copy numbers from GAPDH copy numbers corresponds to differences in qPCR assay efficiencies.

e.g. Mean T-lymphocyte copy numbers=6058 vs. mean GAPDH copy numbers=5483

This deviation defines the cell-type assay-specific correction factor.:

Mean T-lymphocytes copy numbers/GAPDH copy numbers=6058/5483=1.1.

For T-lymphocytes an assay correction factor of 1.1 (average, n=2) was assessed (Table 10, section C). Correcting the relative amount of T-lymphocytes by factor 1.1 results in an absolute amount, e.g., of 26.24% T-lymphocytes within the unknown blood sample RD260314 (Table 10, section D).

absolute amount of T-lymphocytes=relative amount of T-lymphocytes/specific assay-correction factor e.g.: 28.87%/1.1=26.24% Treg cells Additionally, the absolute number of T-lymphocytes per microliter within unknown blood samples was assessed (Table 10, section E). As described above, said genomic plasmid standard (stock solution of 6250 copies per microliter) was bisulfite converted and number of plasmid copies assessed by qPCR using primers specific for bisulfite-converted marker region for T-lymphocytes (section C). These qPCR was performed using the bisulfite-converted normalization standard (section A).

The amount of T-lymphocytes per microliter within unknown blood samples is calculated from relation of known, initial number of genomic plasmids of stock solution (6250 copies) and qPCR assessed number of copies of T-lymphocyte-specific marker within unknown blood samples (see section B) to qPCR assessed number of copies of genomic plasmid standard (see section C).

$$\text{T-lymphocytes/}\mu l = \frac{no.\ \text{plasmid copies/}\mu l \times no.\ \text{bisulfite-converted T-lymphocyte-specific}}{\text{Mean } no.\ \text{of } qPCR\ \text{assessed plasmid copies} \times 2}$$

(e.g. RD260314): $(6250 \times 1896.7)/(6058.3 \times 2) = 978$ T-lymphocytes/µl (See Table 10 below.)

TABLE 10

Assessment of Treg-specific assay-correction factor using a bisulfite-unconverted nucleic acid molecule as a plasmid standard. Assessment of absolute cell number in % as well as of cells per µl A) qPCR for bisulfite-converted normalization standard:

| Standards for Quantification | | qPCR for T-lymphocyte bisulfite-converted normalization standard | | qPCR for GAPDH bisulfite-convered normalization standard | |
|---|---|---|---|---|---|
| Standard-ID | Plasmid Units | CP Value | copy numbers normalization standard | CP Value | copy numbers normalization standard |
| Standard-1 | 31250 units | 23.99 | 30500.00 | 23.30 | 31533.33 |
| Standard-2 | 6250 units | 26.22 | 6510.00 | 25.62 | 6263.33 |
| Standard-3 | 1250 units | 28.65 | 1223.33 | 27.93 | 1260.00 |
| Standard-4 | 250 units | 30.90 | 258.67 | 30.30 | 241.33 |
| Standard-5 | 50 units | 33.14 | 50.00 | 32.86 | 48.93 |

B) qPCR on blood sample of unknow composition for assessment of relative amount of T-Lymphocytes using the bisulfite-converted normalization standard as given under A):

| Sample ID unknown blood sample | qPCR for T-lymphocyte-specific bisulfite converted DNA | | qPCR for GAPDH-specific bisulfite converted DNA | | |
|---|---|---|---|---|---|
| | CP Value | copy numbers acc. to normalization standard (A) | CP Value | copy numbers acc. to normalization standard (A) | relative amount T-lymphocytes (%) |
| RD260314 | 28.01 | 1896.7 | 25.55 | 6570.0 | 28.87 |
| BF260314 | 27.54 | 2626.7 | 24.72 | 11700.0 | 22.45 |

TABLE 10-continued

Assessment of Treg-specific assay-correction factor using a
bisulfite-unconverted nucleic acid molecule as a plasmid standard.
Assessment of absolute cell number in % as well as of cells per μl

| | | | | | |
|---|---|---|---|---|---|
| MK260314 | 27.49 | 2703.3 | 24.86 | 10566.7 | 25.58 |
| LK260314 | 27.69 | 2363.3 | 24.85 | 10700.0 | 22.09 |

C) qPCR on genomic plasmid standard for assessment of T-Lymphocyte-specific correction factor

| Sample ID genomic standard | number plasmid copies per microliter | qPCR for T-lymphocyte-specific bisulfite converted DNA | | qPCR for GAPDH-specific bisulfite converted DNA | | % T-lymphocytes/ GAPDH genomic plasmid units |
|---|---|---|---|---|---|---|
| | | CP Value | copy numbers acc. to normalization standard (A) | CP Value | copy numbers acc. to normalization standard (A) | |
| gnomSTD_02 | 6250 | 26.47 | 5503.3 | 25.88 | 5213.3 | 106 |
| gnomSTD_02 | 6250 | 26.20 | 6613.3 | 25.74 | 5753.3 | 115 |
| | | | Mean: 6058.3 | | Mean: 5483 | Mean: 110 |
| | | | | | Normalization Factor: 1.1 | |

D) Correction of relative amount of T-lymphocytes using assay-specific
correction factor (C) to obtain absolute amount of T-Lymphocytes (in %)

| Sample ID unknown blood sample | Relative amount T-lymphocytes | Normalization Factor | T-lymphocytes absolute amount |
|---|---|---|---|
| RD260314 | 28.87 | 1.1 | 26.24% |
| BF260314 | 22.45 | 1.1 | 20.41% |
| MK260314 | 25.58 | 1.1 | 23.26% |
| LK260314 | 22.09 | 1.1 | 20.08% |

E) Normalizing relative amount of T-lymphocyte
to cell number per microliter using genomic plasmid standard

| Sample ID unknown blood sample | copy numbers of T-lymphocyte-specific bisulfite converted DNA (see B) | no. plasmid copies per μl × no. copies T-I bcDNA Mean qPCR assessed no. of plasmid copies × 2 |
|---|---|---|
| RD260314 | 1896.7 | 978 T-Lympohcytes/μl |
| BF260314 | 2626.7 | 1355 T-Lympohcytes/μl |
| MK260314 | 2703.3 | 1394 T-Lympohcytes/μl |
| LK260314 | 2363.3 | 1219 T-Lympohcytes/μl |

SEQUENCE LISTING (1388 sequences)

SEQ ID NO: 1 - DNA, 50 bp, Homo sapiens
cggtcactcacctgcatctgccctgggcagcaggaggaaggccagcagaa

SEQ ID NO: 2 - DNA, 1024 bp, Homo sapiens
catggaatctgctgggtgggcacctgcttagtggctccagaactcctgggcatttgggagcctgggatagcctggagttgggagtggcctggaggaaggggcttcaatttcctgctctgaaaaagggaagaacagcagactttggtctgtaaatctttcttccatatgtagttgaaggcgagcatacctgtcttagggacagtgaaatcccagaggctcctgatcattcctctcctgactttgctttgtttcaggtgagtttccaagacccttatgagtcctgtggtgtctaggatagtgctgctttctaatggccagggtgtaagtggagggatctagatactgtcatatcctgtttcctagagcctgacatgtagtgggtgcccagtaaatgttcatggctgcatgatggactggctccagttagcctctggatgagggctggtagagcagtgctggtggaattctagaaagcagggaagctggggcctgccgtagtgcctcatccttggaaagaggggagccaccaaaggccagggaagaaaagcagagttggagaatgggactgagcaaacacattaacagtgttctgaggacagtgattgtaccaattctgctgtcagctgagctctgggtttctctcctaagtagacagtgagagaagcacctgtcttatcccagaaacagaagccaggcctactctagaataatttaatatttctcttttctagtttcccatcctctgccatttacttctaggaaagtcctactctccaggtgacaaaggtgggctctggggaagggatagtacccactggctcttcttgagaatggcctgctgctctgccattcctgctgatagcttatccagcatcacacttggggggtcttggtagaatgggagctggagttcagaacattcctggtagatagatggatcaggaatgtggagaaagggcaggagacctgtgggatggggttgggcccccgagggtggagacggtcactcacctgcatctgccct

SEQ ID NO: 3 - DNA, 50 bp, Homo sapiens
ctttggtactgaaggcatctagtgagtaccttgcaccttgtagatgctcg

SEQ ID NO: 4 - DNA, 1024 bp, Homo sapiens
tttgcagagttagccaatagtatcttgtttcctgtaagggagactatctttagatgctgccacaggcaagctcagatactccagggtggaggccagctgccaacaggagggcctgactttataaacctggaagatctaaacctcagggaagactgcggagctggagggagagaggtgccacttaccccaacctggaggtggggggcagggagcaggccctgcagtcagcaaagcacagcacagtcagctctcattaatggggagccttcaggaagctgggagagctcatggggccctcagcttccctgcccacgagagggagcccagagtactcactggaccacactggggcacacacagctcttctcctcaaagtgcagtcccaggcactgggagcttattaaagacagcacctcaagccctgccctatatctgctgaattagaatctgcattttaatgaaattcttagaagagtgatatgcatactaagtttgagaagctttggtactgaaggcatctagtgagtaccttgcaccttgtagatgctcggtaaatatttttttcctcacctctctgccccaaggcatttagtggctccctatacccatcagtcaaggctgaggacacagctttcacccaggacctggcctatgctcctttcacagtctctccccctgccactcttgccctgcagtggggagcctggtgggctccggcatccagccatgcttctgctccctggcctggccagcttggggcgactgcaacgtgaatctcaactgccactgcctcatcaccttccgatcacttcattacctgcctgacccctggcatatgctatataattctgatccatccctaactagggcctggcccatggtggccttcaatacaccttcattaaatggtctgtgaccccttcaaggcccctctggccccttgctgcccacatcccagccacatccggtgctcccttacctctagtcgctgtggtgttccgaggacagcgggtgctctgtgtgc

SEQ ID NO: 5 - DNA, 50 bp, Homo sapiens
taatgacagtttaacactgtcacacattcccagtctcacacatggtgacg

SEQ ID NO: 6 - DNA, 1024 bp, Homo sapiens
acctatggacatgcccccacattgtagcccgccctgctctcacaatgggtcatataaggccattctcagtcacactgtcacactcactgtcgggatgacatacagtgctaagtcacaccatctccctcagtctcacataatcacacacactgtcatgcacaatctcaaacactgtcacatacaatcttagtccaacaacaaaaactctgttcacatacagtttcacatacagtgacacagtctcacacactgtcacacaaattctgtcgcagtttcatgtggtcccatatcaacagccacacaccgtacacaaccacacatagcctcacacacggtgacatggtctcacatactgtcacagtctcatctaatcctacacacacggtcaagctctgttcacaaagtcacacacactgtcacacagtcttacattatcccacacacacaggtcacacacacagtgacatggtcttacacactgttcacacgtggtctacacataatgacagtttaacactgtcacacattcccagtctcacacatggtgacgtggtcttaagcacatacagtgtcacacagtcccacacggtcccatatactgtcaaaggctcccgcatacaccggggcaacggtctcatactgtcgcacacattctcacacccagtctcatactgtcacacatagtcccacatttgtcccacatggtctcacactgacacacatattcacacacggcctcacattctcacactgtcacacacggtctcaaattctcacacagtcacacatggtctcacacacgattccacactgtcaaacacattgtcacacacggttccttaatgtctcacacattctcacacactgtcacacacggtcccacacatggtggcatggccgctcccggcgtcagctccatcccgcgctcctcaccgcctcctccctccagtgggcacctccttcggcgcggtccttggaggccggggctgggccagggcccgggccagggctcgatcctggccgg

SEQ ID NO: 7 - DNA, 50 bp, Homo sapiens
ctctcacttaccatctcagcagcagtgtctctactcaggttcaggagacg

SEQ ID NO: 8 - DNA, 1024 bp, Homo sapiens
tgaaacccctctgtgcctctctgtagtcagcactgtctcaacaggacttggtctcggggcacagtgagcgccccaaacccacagctcctgtctcatgaagtgacccccactttaccacctgtcccctggtgactcctggccattgaatgctaggtctgcccatggccgctcagctgataaaggagctcatgtgactgccataggggcacggccagcagcctcttgagcacccagttgctaccccctcctcctgcagccagctgactggagagaaagtggacaaccctgtgtggtgccatctaaaatggagtccccacctccaccccagggcaggggcttctggaaagctatgtcagagagaagcatcttacctggaggtcaaacatttctgagatgacttctactgtttcattctgtagaaaaggaaaatgtcatgttatcaagctgacaggcgtggccagtcaggggccagctgggtggcctaggcacaggcccacattctctcacttaccatctcagcagcagtgtctctactcaggttcaggagacgccgggcctcctggatggcattcacatgctcccagggctgcgtgctggggctgggcgagcgggcgggtgcagagatgctgcaggccacagtgcccaagagcagcaggctctgcagccacatcctccagagaactttagcctttctctctgtgtactgggctcactggcaaaagagctcttaaatacacagaggaaatgattaatggtgaccacaaaatgccagggaggcgggggaactacctgaactgtggaatctcctggcccttatcagccacacatgggaacggtgagccttttccctaggtggtcaggcttgggggttttcattaatgaacctttccaagaaccgacagcccacccacccgccttcctgagggctctccagccctccctgggcagtctgaatgggcctgaggctgccccctccctctgaggggcacagtttggacttcctggcctggaatggctggggtgg

SEQ ID NO: 9 - DNA, 50 bp, Homo sapiens
cggcaaagccacgctcaccttcctgaaccgagccgaggattacaccctta

SEQ ID NO: 10 - DNA, 1024 bp, Homo sapiens
gctcggctctctgctgggtgtgtggaactctgggagggggtcccaggtgcgaccctcaggttcagcccacctttcccaactctgtcctctcctcaccagcagtacctgcgactcgtggccccaagcgaggcgtactccctccacagggatgtttaaaatctgagcagggctcagtcgagtttgaaaaagtttgcagcctccaccctgcgaatctgcagttttgcgactgcaataaaccactaacaagtcaaaggtgaaataacttctcagcacagatgtcctgtgcacactggacaaggattttacagaatctgaggcccagagaggttaagtgactcacgcacagacacaccactggaagtgccaggagcgtgttcagctgttggaaggagctcagaccctgtgacttaggggtggcctcagatgtgaaagggctgtccgcactcactggtcctgctgtctcttgtctctgcagggaactcgctgtcggcgctgctggacggcaaagccacgctcaccttcctgaaccgagccgaggattacacccttaccatgccctacgcccactgcaaaggtgagaggctcagccacacactccgagggcagagccaggctctgtgagagcagctagatgctaaaaccctttggttatttgcttgaaggtatctttacttcgccttcatctgcccatgactttttttttttttttttttgagatggagtttcgctcttgttgcccaggctggagtgcaatggcgtgatcttggctccaagtagctgggattacaggcatgcgccaccacgcctggctaattttgtatttttagtagagacagggtttcaccatgttggtcaggctgatctcgaactcccgacctcaggtgatccgcccgcctcggcctcccaaagtgctgggattacaggcatgagccaccgcgcccagcctcgcccatgacttttgaaggtgggtaattccatgtagatgctattttactgccctttgaatatgtgcgttttgcttgcc

SEQ ID NO: 11 - DNA, 50 bp, Homo sapiens
cggttatgaaagcttgtgagaagaaaatctagagggctctggagttgcta

SEQ ID NO: 12 - DNA, 1024 bp, Homo sapiens
gaagaagcaaggggaaaagaaataaaacaaaggaaatgtccaataaagaccaggaaggaaggtccgcaggtggagacgtgcgtgagggcagggagagaagggtaggaagagggaacgagagcggcacgaaggcctgggattagagagcggtgggaaaagggtagtgggcctggtgaggggagcaggagccaggccggcaaggggcaggccatcttaccgaagctgtgatgaatgattctccacccaccaggtcttcccttattgaggtggaagcggtggcgacggctggctggtccatggtggcctcctctctctctaggctgaacctgagctccggttgctaggaggcgggtgtggcccgtgggctcccgagcgcgcgcgcctgggaccgctccgggggacccgccaggtttgtctttagtgctgcagggaagggaagcgggcacgcactttgaggtcccgcgcgaagaactgcgcagaggaaaaccctcgaaaagagacggttatgaaagcttgtgagaagaaaatctagagggctctggagttgctagagagccctcgggtaaggatctgcgaaaagggaggcttgttaagggcttgagcgtacccacaatctccattagttcccttccaatccaccaccaatcgcacaccccagacagggaggcagtgtgcttggtaggcatacttaagagaaatctgccttagcacccactttctaagattgtttctaagctcctccaaatagaaactctggggctgacttctcttgcttctgacttgcagagtggagtgagcaccagacacagccggtttcactagctgtgaaaccacagaccaccccattcttctcagtatagaccctttttattgtcagcctctctaggctgtagcttcttcttaacctaggaacattctcacctttaaaaacaaaccctccacaaccttaatttcattttatacagtacctactgtattccagggacttcacacacattagtctcatttaatcttcataccaacc

SEQ ID NO: 13 - DNA, 50 bp, Homo sapiens
aattttagctgcattttctgtggcctggcaaagtgggccagtagctcccg

SEQ ID NO: 14 - DNA, 1024 bp, Homo sapiens
gtggagcccctagtacccagcaagccagcccacccaccctgcagtcctagaaaagagctacaggtcatctgcagccacccacatctacccgggccaccacaccactgtcacctggacagcactccccaggccgacctccccacctacccgcacaccctctcaagatgccccagtctccaaaagccacctcttgtggttcccttggggacaccctaggccaaatgctctgcccatgacacccccatctcagtgccccttgctcccctgggacggcagattccccagcactattcggcatgccacgcgttgtcagccacacttgagtgaagtcaccagctccacccgctccaggctcaccacacctccctctcccccttactacatctcagtgtcagcctcagcttctccccaaccccaccccccggccctgggatgaggggccaggctggggccaggagggcaggatgcctgtcagtttgtccacctgtctgtccttagctaattttagctgcattttctgtggcctggcaaagtgggccagtagctcccgcggtgattctgcggtttctgggacacggccacgctgggtcaccagcaaagtggggcgcagggggcgggctgcaagcggggccaagggcagggaaggagacacatgccagaagcatgtcagggacaggggtgtgtgcgtgccagcgtgggaggaggcggcaggggaggccgtgcaggccgagggtgtgtccagcctccttcctgcctatcttgggcagtgggggtaggctgcccttgaccgcttgaccaccgaatagcgcctgcggcctctgaggggtcccgggctcctagtctgatggccgcccttggcccctgcagccgcctgtgatgctgccgtcccccgtcgccccgtggccccacaatgacccacagccccgcgacaagcgaggacgaggaacgccacagtgccagcgagtgtcccgaggggggctcagagtccgacagctccccagacgggccaggtcgaggcccccgg

SEQ ID NO: 15 - DNA, 50 bp, Homo sapiens
cgcccactgcaaaggtgagaggctcagccacacactccgagggcagagcc

SEQ ID NO: 16 - DNA, 1024 bp, Homo sapiens
ttcagcccacctttcccaactctgtcctctcctcaccagcagtacctgcgactcgtggccccaagcgaggcgtactccctccacagggatgtttaaaatctgagcagggctcagtcgagtttgaaaaagtttgcagcctccaccctgcgaatctgcagttttgcgactgcaataaaccactaacaagtcaaaggtgaaataacttctcagcacagatgtcctgtgcacactggacaaggattttacagaatctgaggcccagagaggttaagtgactcacgcacagacacaccactggaagtgccaggagcgtgttcagctgttggaaggagctcagaccctgtgacttaggggtggcctcagatgtgaaagggctgtccgcactcactggtcctgctgtctcttgtctctgcagggaactcgctgtcggcgctgctggacggcaaagccacgctcaccttcctgaaccgagccgaggattacacccttaccatgccctacgcccactgcaaaggtgagaggctcagccacacactccgagggcagagccaggctctgtgagagcagctagatgctaaaaccctttggttatttgcttgaaggtatctttacttcgccttcatctgcccatgactttttttttttttttttttgagatggagtttcgctcttgttgcccaggctggagtgcaatggcgtgatcttggctccaagtagctgggattacaggcatgcgccaccacgcctggctaattttgtatttttagtagagacagggtttcaccatgttggtcaggctgatctcgaactcccgacctcaggtgatccgcccgcctcggcctcccaaagtgctgggattacaggcatgagccaccgcgcccagcctcgcccatgacttttgaaggtgggtaattccatgtagatgctattttactgccctttgaatatgtgcgttttgcttgccttgtggcttccattgctgttggggatgatcagctgtcagcctatttgttacctaatctgc

SEQ ID NO: 17 - DNA, 50 bp, Homo sapiens
cccttcacaacctgattgctaagcttgttagcatagaggtggtctaaccg

SEQ ID NO: 18 - DNA, 1024 bp, Homo sapiens
cagtacaaagtagacgcacgcacacacgctcacacacacacagaggcaggcaggcaggcaggctgaacacgctggctgggaactgctgtcggagccctctatagcaggagaggagagggagaggagaggagggagggaaagagggagggagggagggagcacgggagaggagggagagggagagagcaggagctccagagagggagggaggttggtatggaggaagggagggaagaagggagggagggagggagggaggagggagggagggagggggagagagagagagagagagagagagagagagagagagagagagagagagagagagagagagagaggagctggatagctttaggcaccactgcttgtttttaaagaagcagtttgtggagaggtcatttcctgtccacattgtagactagttcacaaatataattctcctcacagtctgacaagaggtctaaggtttggttttaatttttttcctccagccaggacccttcacaacctgattgctaagcttgttagcatagaggtggtctaaccgctacatgagccgctcacccctgacaaccacactgttgtaatgtatcagaaatgttgattactacaaaatacagaaacacgggcactgtggtgccccgaattgggaccggtgattcactcacatgcagagatttatttcagcactaatctccctatgtagttttgctttacttgctgttgttccaagggctgttatattctttgccctccactccatctcactcccatctctccccactcacccctcttcccagccacctccctcttctccaaagacttcattcaggcccttaaggtgcctgggcattttcaggtaaaaacagtcgttctgaatgtggaaggtataaaatacacttaaggagagcaatggtcttttttcccaggaaggaaaaacaaacaaacaaacaaacaaaaaacccaaacagacctcccaataagacaggaaaagcaaagaaggagaaaactgccacaaaaa

SEQ ID NO: 19 - DNA, 50 bp, Homo sapiens
ggccgggtgcctggtccccccaggaggctggtcttggagcaggtggtccg

SEQ ID NO: 20 - DNA, 1024 bp, Homo sapiens
gaggaagtgaggtctgcccctggtcagccccactccccactccctcaacaccagggtgggccctgtggggccctctaggtaggtaggtcaaggtggggaaacagctgcagccaaagattccctaccccagggagggaagagggagctggcttggcctgccttgccccttaggggtaggggagctgtgacagcccatttcccccctttaagccctagatgtaggggtttggagcagggaaggccatcacctcatagaccctggggcaagcatcccagaggcccttccggagcctggacctcgctctgctttccagcccaccagccagctgctgagtcccaagcccctccttgggcttgatcccctgggctgcagctgggaacaggctggagacctggcctgggaagccactgagttgcccccacctgccctgagatcccctgtgactgggctgggccccgatcttccctgggggccaggcccttacctgggtgccagtgaaggccgggtgcctggtccccccaggaggctggtcttggagcaggtggtccggtgctggtggtggaaggacagcagcttctctgctagtggccacaggcagagcctgcctttgatgaggttacagaggcagccacgcctgtgctctttggactctggtgggtggggaggcttcctggtcactaaccgctcaacatcaacctggacctgcggcagtgtctgtgctgactggcgtccccagcttagctagaggcccctgcttccctgtttcccccactgctagccttggggtgtggccccctcttccctctgccttttaggtgcctactctggggaacaggtcagcatcaggcacggggctgggaccagaagaagagagcacacatggcccagagtctgggttctgtggtgagggcacaggtcggctggaggtggactccaggcttgggggaagctgtgggctggcgtgtgtgccatgcctgtgcgtgggtggcacccataggtgtgtgatcctgtgtacctgggtgg

SEQ ID NO: 21 - DNA, 50 bp, Homo sapiens
cgatctttgctgagtgtctatctagcctcagatttataagtctgggtgtg

SEQ ID NO: 22 - DNA, 1024 bp, Homo sapiens
gcctccaattagcctttggctgaggtttagtgggggtagtgctggtgggattcaggacctcagggatgttagagggggttatcaccaggtcagtggagtagctgagggcctgcaaaggcagaaggaagtggagaaatcaactaaaaatgaatcgcaaagcccaggtggagccaaggtaatgggagagctatggacacagtcatcttgccatctctgagatcagttgcaccatgggcttccctcctggcaggggtgactgggtgggggcactgaataagtggttcttaagctgagtccagtaacaactcctatgactgcaacttggtgtctgagctcctctttcctgggttggagtgtagagtaataattacttatcttttttagcttcacattccctaccaaatgcctttctaagaacaatccacactccaggtcataaaggagaggtctagggagaggctaacacccattaaaccttttagggaacacccttcatttttcgatctttgctgagtgtctatctagcctcagatttataagtctgggtgtggaatgggaggtgggctcagattgaggaaaattcctgaccagtgctcatgggtacagggtatcttataagatgggttcaggcctctggaatagggatagtcacttacctgtcccagccccaggggtcagaagaaaggccaacaggaggaggaatggctgcattttctcaggaaggctgcccaggtcagagctgttggtgttgactccttccagaaacaaatgctggagggagatgaaggagggatgggtacagtaaactcagagacctcctagacttgtccccttctggttttgatgggtgtcattatagaaggtggtttattaaaattatctggtttggtttaagttgacatggcactgtcacatttacacccctgctgctgagtaacaaggtgaaagcaagaataaagaacaaggaggtggagctgttgaagctgtggctgcagctagcagaaaggctggtactgcagaagct

SEQ ID NO: 23 - DNA, 50 bp, Homo sapiens
cgtccatggtagtaaggcagatccatggagaacgctcttgtatcccagga

SEQ ID NO: 24 - DNA, 1024 bp, Homo sapiens
aataagtgtttcagattgaaatttcttgaagaacccctagccttttccataccaaataaacagatctctggaggacaggacctctgacatttgtaccttctttccatccctctgtacccctgtacttcctgcagcccttcccttcaccaccaccatgtccctcctgctgctgcagagtctgcttgcagggcctttacaccagggagagcaggcagatggaggagcatggacagatacattcctctcctggcagtgtccattacttctcattctactcattgagactccaaagtcagagtgaaatactgagggatatgaattcctgtactgtgtggcagccattgccacattcaacatacgatgtcagatgtgtgcaagatgaggctactcacgagacacagaggcacaggactcctggtatcgactcgctgtctcttaaaagaaagttgccatccaccccttccttgagcagcaaggtctcacagtcttgcttggtcagacgtccatggtagtaaggcagatccatggagaacgctcttgtatcccaggaagccctgttggcctgaaattcacccccaagtcaagggacagctctgaggagagatgtgtaagcagctgtacctcctgtggagctacctcttcctctagcggtctgtgggactcagccagcttcacaagattcaggaaatgaggagggcggggtgataaaatgaccaacacttttcaccctctaaatggcccacatgtgactcacagaagtaggtaaagcacatttaaacacacaatggaatcagtgatgctcatggctagggaggcaatgctgaagtcaagcttcctggaactgtgttgcagccttgtatattaccatggactatcatcaacttctttggctactggtatcctttccaggaagcacaccgctgcttttgctgtaatggtacccattttctgctgaagttgcctaggattgggctatgcttagcttagactgggtgctcaaaaaccatttggatgctgagagaat

SEQ ID NO: 25 - DNA, 50 bp, Homo sapiens
taggagctcaatccacagctatagatgtggtgaggggtcccatcccttcg

SEQ ID NO: 26 - DNA, 1024 bp, Homo sapiens
ttgagtaggggcagagatcagagtgattagaacatagagtgagtttaaaactcccctgccctcctctgccccaggagcccaattttcccaagaatcaggatgtttctggtggaaaccttgctacctgctctctggtctccactgttcatgcctcttgcgccactgtcaacacaaatccctattttcaacactgctcccttaccccttgctccctgtgcaaactcacaaattaagggtacaggttgaatttccctgaaccaagctacagaaagagcctcaacccatatccccacaagaaagggtagaaattgaaaatcatagaggagaaccctggaatgtcaaactgaaagagacagaccctagggaccatctagtcgaagctctttggttccacagagtgattctgggacccagaggggtgaagtgactggcctcactcatgagtatgccccaattggaaccagcattctcctcatttctagccccatcttggcttgtcctaggagctcaatccacagctatagatgtggtgaggggtcccatcccttcgtgggagtctcattcgtagcctgaaaaggggtctctgctgaacccaaggcatctcaaacttctccctcaaccagggagaccctgacttacctagaagtagcagagcagttgggaggagcagctgccacatgatgccacactggagtggacaagtcaccaaagatatccggagccctaaagggaccaaaccgactagacaggaggaagtaaacagcctttccccagcccctccacccatctctgtcacccaccaatttccttttcttgaaacttcatctgacttctcagtctgaagtctggcaagggagccccaccatagaacaggaccaggaaggaaagagcctggaggcaaggtgggtgggtctgccccctttactccctcaaaggtctgtggctgagcatctgaggacacacacagaatctgccagagtgtgccctcagccatcccaggatgcttgccccatctcctggattt

SEQ ID NO: 27 - DNA, 50 bp, Homo sapiens
ttatcaaattcaagtcctctgccagcaaatccaggatgtttcattctacg

SEQ ID NO: 28 - DNA, 1024 bp, Homo sapiens
ccaaaggcacagtgagctcacatgtgggcacacacatggggaggcacagatctgtgggccccatggggatgtcctggccaggctctgtctcagccccagaccccacccctttccccagacaggagccccccggctggagctggatctgacctgcccttgggaggtcagggagagccctgggcatcagagcgagcatgctcagctcctcctctttgatgtgtctgtggaggagggctggccaggtttctgcaggcactctggaggcccaaactccaggcatgaaaccccatcaccccacccatttaattttttcacccccttgctgtcagcatgcagacccctttattttttgattggggaagtagaggtcggaggtggagccaggaaagggtttgccatccacagcccacaaacacacaggcacacccacagagacacaggcaggctgacacaaggacccctgcagcacactcacaggccacagcccctgcccaggcaacttatcaaattcaagtcctctgccagcaaatccaggatgtttcattctacgccacgtccacattagcaccatcccctgcaccaccactgccatcccctctgtggctagtatccccacgaccaccagcagcaccctcactgcagccaccaccaccgcagcaccacaccgtcatcggggaactgatggaggagccctctaggattctgatacagcatggaggagacccccagtgggaagggcaaaaggagggcgatgagcttcctaggagcccagaagacaaggtccaggacctcaggcccctgcagcagccctggactctccaaactccagccctgctggagacagtgtcttcccagtctgtgtctgagccttctctcccgcccctccctccctccctcccacacccacagaaagctggtctctagcaggtgctagcgccggaggtggaggcggctgcagagagagagaagcccaggagggaggggcacagccctggctgaacccacaggattggtcaatctgcat

SEQ ID NO: 29 - DNA, 50 bp, Homo sapiens
gggacatactgtgaggcagactgaacggtacagtaggtggcccagttccg

SEQ ID NO: 30 - DNA, 1024 bp, Homo sapiens
tatacactctcgtatacacacaaacctgcacacacagacagacatccacaaagagctgcacacacatgcatacccacacaggcaaactcacccatacttagagacacacaaagacgcacatgtacaagcacactgaaagagtcacagaaacacaacatatcaaagcaataggacccaacctgagcaatatagcaagaccttgtctctactaaaaatcaaacaaattagccaggggtactggcacgcacctgtatagtcccagttcttgggaggctgagaccagaggatcacttgagcccaggagatcaaggctgcagcaagctatgattgtgccactgcactccagcctgggcaacagagtgagatcttgtctcaaaacaaaacaaaaaaagcaaagcaataggaggcaaaaatatgcaaataagcatagcaatatcccaatgtagaaagccagccccagagatatagacatgagccaatgggaagagaagcactgaggggggacatactgtgaggcagactgaacggtacagtaggtggcccagttccgcctttatcccttacagggaggaccccaatctaggcccaagagggaaagccacgtgcctgtatgagcgtatgagcatgtgcatgcgcgtgtgtgcacagggtggtgcacctggcaggggtccttgagtgaggcatgccccattctgtagcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcaggtgagtccaaggggtcggaggcaggagctgcctggatcctgggagaaactgagggaagaagaagagatgcgaacttgcccttaggag

SEQ ID NO: 31 - DNA, 50 bp, Homo sapiens
tggttgaacaataaacgcatgactctccctgaatcttgcgtgtgtgcgcg

SEQ ID NO: 32 - DNA, 1024 bp, Homo sapiens
aacctgacctaagtcacctgaatcccaagtgagaagaaaatcctaaacctcgtacccaaacctgtctccttgatggcctcaaccccattcccaatgccatccccaaccacaaccacaatccttacctcattctcaacccccagggctcctccaaccccattccctatcctctccctaatcccaaagccactcctacctgcctctctcttccccactctcaataccctgttcccaaacccattcattcccatccctgtcaccagtcccagctccacttctgcgcctcaaccctaacccaccctctttaccaacccctttctcctcattgcctgtgtacctcagcccatctttaatgtcctctgaatctacagccccaaagagctccatcctcaacctcagccacagccctgtgtccatccccacaaagaaccgcattggccccacatacccagacacctgtgactccccaccccactgcctgctcttcaggtagaaagccctggttgaacaataaacgcatgactctccctgaatcttgcgtgtgtgcgcgcgcccgtgtgtgtgtgtgtgtgtgcgtgtgtgcgtgcttacacagctcggacaaagccagggttgctttgagcaaggctggcgacaaggtattgggttccggggagggtcacagaggtcagtgagtgggtggggggagccccctggatgcctgcttcagcgaattccatttgaggcctctgccaccgctgcatttctgcctgctggaagctgctgggtagtgggaccattgtgtagggaggcttaagggatttggggaacctaagggggcaaagaggccagtgaccaggctcagctcagtctgcacagaggggccgtggcagaaggagggctcgggcaggctctgccactcaggtaggcaccaggcgtgagacctgtagccccctcttccccaagtcccaggagtctagggtcccagctccttcttctcccaggacctggtgtcctaccccctagcccctagccccttccttac

SEQ ID NO: 33 - DNA, 50 bp, Homo sapiens
ggggctcacatgtgattcccgccctccagcgtgctgagtttagcttaacg

SEQ ID NO: 34 - DNA, 1024 bp, Homo sapiens
caaatgacccgagaagttgcgaggctccccggtggcggggacggggggcaccccgacggagccctcggacccttcccgccctaggacgaccctgcccgcaccgagccccggcccagctgccgcgccctagcccacgccggcgcctgcgcacctaccatgcggcccgcggcccgcgagaccccggcttccaccctccgagcgacggacacagacgcggcgcgggagccagtggactgactgacagcggccccagcccgcgccccgacgccccgcctgtccggccgggaacgccgccagggggcagtgcagtccccgcagcccgggcggcgccccctcccgcactggcggaggacgcggccgttggaggcgacacctccacaagcagcgtggaggcgacacctccacaagcagcgttatctgacggaaccctcacaacaacccgttttacagatgagaaaactgagcctcagagagccgcagaggaggagcccgagagacctggggctcacatgtgattcccgccctccagcgtgctgagtttagcttaacgccgtcacggtgtccctgcggcctccagctcctcctgccccccattcagacccacctccaaggacagggacggcccaccagccccttgaagtcgacatgccccggtgcggttcatcctcccaggctccaggcctcttcttctgtcccaaggcccatgattgcagcctccgcagcccctctcacccgctgctcccttcggggcctccagtccctgagtccaggcgctcggccctgcaggactgggcaagagccccctattctccctccagtccatcctcccacagccaccaacgaccatcaccccctcgaaacccttccttggggcccccccactgccttctgaaaaagagcacaccaaagtctagcctgggggtggacctccccactcctcacctgcctccctgggccaccctctcctcaccattgtcctcagccccaaatactgtcccccttatccgttcaaatgttcttctgc

SEQ ID NO: 35 - DNA, 50 bp, Homo sapiens
aggccaggcgcagtggcttaggtgaaggccacaccagacttgggcctacg

SEQ ID NO: 36 - DNA, 1024 bp, Homo sapiens
gatacaactggttaccgccctgtaaagcagataataataaacattacatttcagtgctctatagaatagtaagcagatttgcctcttcttgcctctatgtctactcttcacagtctcacgtgaatgggttgcagtatcttgctggggttcccttcctaattaaaagagttataaaaattttgaccaatgttcattttatatttctaccattgtcatgtttttaccttcttgaaaaattattttttaagagttcctgctccctaggctttttggaaggattggtttaaacatctgtattgacagtcatgatcagttttatatcttgcaggaaggtggtaacacttccggtacttgggggtgtaagaggttgtactgagcctttagaaaagggcggggttcgggggggagtgagctgaaaaactctccctagacaggaaaggtagaagacctcctcatccctttctctttggcagtgagatcttaaggtcaaggtgagtagtaggccaggcgcagtggcttaggtgaaggccacaccagacttgggcctacgtcttggccttccaggtcagcagagtggcctgggacttggatgccttggggtcacggagttaactgcagactcagactaagtggggccccagcagcggtcagccccagaaccaagttccggagccaacacccgaacaggaaggggccttgccccaggccggagaggcccctcgcccacggccgagggggtggggcggcctcgcctcgggccggtgcttttcgcccttccttggccgccagaggctccctctctctccctctcccgggattttgctgccgggctccctctctctgcggccctagagttaatcccatcagccgaggtgaggcacctgttaccccggccttcctcacccccgcggcctctcctccattacaccgcggccgccgaaacggcccggcgtggcgaccgcacgtgggccaaaccccttccccggccggcacccctggccccaggccggcccgagcgtgcggg

SEQ ID NO: 37 - DNA, 50 bp, Homo sapiens
ctctgtgcctggtggggtccagccctgtatgtggacttcctgggggaccg

SEQ ID NO: 38 - DNA, 1024 bp, Homo sapiens
gtctgccttcacgtgtgccggggagaacagagattccctttggcgtcatgcatgtgtctggattctctcagaaaggaggaggacgtggaaggaggaggacgtggccagcaccatggtctcagtggggcttgaggagtgcccctgaggggaaggggcaggttggctcagcctgtggtggtttccatggtggtcactgccaaggctctgcagaagcggggttggggcctcccaggggccaagactgtcccctcagaccagtacagggctcccctgttggtcccctgtgccgtgttgtgcgtgtggagggcctgtctatagaggatggacaggctgtgatctgtctcctacccctggccccagcaggaatgctgcaaggactgtggtgactctgggctcatgggagtgctctcctgggagtagtggggaggggaagagtggtttagggggagcatccgataggaccaggtagccactgagcatgcctgtctggtgggcatagcctctgtgcctggtggggtccagccctgtatgtggacttcctgggggaccgcctgcatgctgggaaagtcctgcaactgtgggctctgggccggacccctcctccttggggagcgttgctgtggtctccgcagcctgttggtgtggtctgagaggggactggtgtgtggtggtagggacgcaggtgctcaggagggctcctcaggctgcctctctgcctgttactgctgctccctccctggtcctggggactcgctcaggcctggatgtgtggttttggacaccttggaaagaggttagctgtgagttttgctttgattgggctttgagctgctgagctagatctgtccaagcatgcttttgtggttttctcgagtctttggtcaccctgcgtagaattacctttacttttgccttcattttaggtaatcattaccaaatgaggaggaaaggacgatgtcatcgaggctctgcagcgaggcatccttcttccccatgcagtgttaaacactcccctacgcgagaa

SEQ ID NO: 39 - DNA, 50 bp, Homo sapiens
cgcagacccaggccacccaggggcgacacacttgaccaggtgacacctgg

SEQ ID NO: 40 - DNA, 1024 bp, Homo sapiens
cgcatcccagggcccccggcccatgccgccgccggtccctcccggcgcgcccgcgcctcctcccggggccctcagggtgcagagataaggctacaggcgccgcggggaggggaccagccggcggcttccggcgccgccgagggaagcggggggcgctgcggggtccccgggaggccgcagagcgcgggtccttcctcttgtcggggcctgggcttaggacacgcccgttccgcgtccgtctctggctccgcacttgctgccctctcgccgctcacattcgcaaagggggacagacactcatcggataatgacacagctggacgcagagccccggagagtgctggggaggaaatgttgcggaggattcaagccactcgagggctcagggaggcacccccggggagaggggtgaggggagcaaggggcggaaatcttccaggacgtgaaagggagctggatgaggtgaccacagcgcaaggcccagatgagaggtcggaagacgcagacccaggccacccaggggcgacacacttgaccaggtgacacctggtcaccgggagtgagagagagtagggctgtgatggagggaggggctggcatcagtccccgctgctctgaggacacccggcttgggacgcgctgatgccagcccctacctccatcacagccgtactcatcccaagggaaggagtaaaccaagacccaaggatgagaaggacgttggggaggaatctaagcgggagtttgttgtagaaatggggaatggggacctagagtgagagcagagggttggagaggggcgttgagctgcagagggaagttagccctcctaacccaagtgatggaggtcgccgggaagctgtcacagtttcaagcagtgaatgacttcatcactgacacatctctgtctgttctgtggaattgggattggggttgggttgggatgtggaaggcaaagagtccagcccggagttgctgcaggaatcaggcaatagaagacatgtcctggcccggtgcggtggct

SEQ ID NO: 41 - DNA, 50 bp, Homo sapiens
aggaagtcctggccagcactccagctctgctgttgatttgctgtgtgacg

SEQ ID NO: 42 - DNA, 1024 bp, Homo sapiens
tagacagagtcccgttcttgtcgaccaggctagagtgcagtggcacaatctcggctcgctgcaacctctgcctcccaggttcgaatgattcccctgcttcagactcctgagtagctgggattacagatgcccgccaccacgcctggctaatttttgtatttttagtagagacgaggtttcaccgtgttgcccaggctggtctcgaactcctgacctcaggtcatcagcctgcctgagcctcccgaagtgctgggattacaggcgtgagccacagcacctggcctggctctttggtgtttatgatctgaagggtgttggttgatatgcatgaagacgaggacatgggttccagaatgcaaatgtgaagtccaggtccttcatctctgacctgggaggccctttaggagcagtaagtcccctccctcgtgtctcctctcctgctcctttccatggagcaatgaagaacctcaaagtagctagctgtgggggagaagggacacaggaagtcctggccagcactccagctctgctgttgatttgctgtgtgacgtggggacagtatcttagcctctctgtgcttgggacctcctctgactgtcaggatcactgccctcccctcccagtgctatctggggactgggctagataatgggcactggatccgctggagatgcagtcctgagcctgaccccagtgctcatttcacatcaggctcagggtcctgccaggaggctgaatgccaaaggtcagtggggtggtggggagggggctgcagcctgccctgtccaccaggggagtggcatctggtctatggtgtcagccctggtctggatccctgctcctttctgtggcttctattcctttcatttattttagtttagtttagtttttgagacggagttttgttcttattgcccaggctggagtgcggttggccaggttgattttgaactcctgacttcaggcaatccacctgcctcagcctcccaaagtgctgggataacaggcaccgtgaccagccatc

SEQ ID NO: 43 - DNA, 50 bp, Homo sapiens
ttcagtaccgtgaataaatacacacaggaagacaactctgggctctcacg

SEQ ID NO: 44 - DNA, 1024 bp, Homo sapiens
ttctgcctcccatatttccccccagtattttaagctccctttactttaagtctgaggttgcagtgggagagtctgaagttggcagtcggagaaatgtgatgggtcaagacagaatgcaattccaagtcctcggggtcctgtgtgcatcactcacaagtatgctactgtccacatgtcagtcactgggttttagccaggaagatgttcatccattccagtttagagtctaaactaataacatgggtaaaccaagtagcagagagatttgcccaatatcacacaggtagctcatggcggagcagggttagaagtcacataagctgatgcccagactcatgagctttctctacaccataatggaccaaatgaaattgctgataccccccaaactgccaaagtatgtggcttcaacttactttccaatacatgctaatgttccaaaccaggctatctgggaggaacacgaggggaatcatgttctcccattgtccttcgaatgtttcagtaccgtgaataaatacacacaggaagacaactctgggctctcacgtgcagaagctaactcacacctcactcacacatgctcgacagcactgcaaaacaagcccatcactatttccagagcggccatagctccccatgcagcataaacatacctgccatctagatctgcagccctgctctgtatctagttgacatgttgtgataatctagaaaggggtgtcttcagcttatcttccaagtgtcacaatcatctttcaccttattccacacctcgttagtgcacaaggttgttataggacaagcgaaacgaagaggcaaccttgcctctctggagtcccagagtctccccatcaaactgacttaagcaatgagcaaaatagtattgagtaagccacccatttgtgctttagtcacttgctaaaaagagcaccaaccactgaaaacaatatttggcccctattcttaggaaatacacattgaagtacttaggtataaaaggacatagtgtttataacttacc

SEQ ID NO: 45 - DNA, 50 bp, Homo sapiens
aaggctgtgcaggaccagctgcaggtcaatgacaacacgcagggaccccg

SEQ ID NO: 46 - DNA, 1024 bp, Homo sapiens
cagaacagtgttccttaggttgaggcctctttgatccattcaaatcaagatcattatgggtccagacgtttcggactgcaggttttgacgtcctcttttggagagcgtgcaatctgaatagacagacgagaattgcctccgggcctcaagcttcgagaagaggaagcagggaacctgagaggccaaagacaaagcagttttgccaggccagagccctaggccagttttcccagaggccagacctgttttcattccctgcctaattccattcctgacaaacgtgctcacctctggccatattgcccaactgggagcaccaggggagggttggtggtgggagtgggcctgtcccaggtgtcctgccgggggtctttttgcagccccctacattcctgcctgttggccttatctgtggccctttcttcagcccctgcaggtgccatgactcagcagccccaggacgactttgacaggagcgtggaggatgcccaggcatggatgaaggctgtgcaggaccagctgcaggtcaatgacaacacgcagggaccccgcgcggccctggaggccaggctgtgggagaccgaggtatgcagaggcgtggcctcagatggccctgtggtcttggccccatcccaccccgccctcagacctcaggtttcctatctgtgaaaggcaacggtggactaaaccaatgtttctcaaactctgatgtgcacacagatctcctggagattttgtttaagtgtagactctgatcgggtcatggaggtgaagtccgagactttgcttttgacaagttccaggtgataccatttttgctggtccttggaacacactctgatgacaaggaactagagcctgtcctctcatcctcctgtccctgcaggggggacccgtgcagcctggtgggtccccagcccttgctggggggcttcccaccccttctctgcttctgcctggttggggtccctgccagatctgggttggccaaggtcttcctccagaggagcggggaaggggctct

SEQ ID NO: 47 - DNA, 50 bp, Homo sapiens
atcgtgtctcactctctgtttccaagtgtctgtggtctgtggcactgtcg

SEQ ID NO: 48 - DNA, 1024 bp, Homo sapiens
tttggggagtgtgggggacaggagggaaagaaacctggtccttgtagccgttcgtctgctccctgccctgggcagaggacgtggggactcaggccagcctgagatcactgggaccagaggaggggctggaggatactacacgcaggggtgggctgggctgggctgggctgggccaggaatgcagcggggcagggctatttaagtcaagggccggctggcaaccccagcaagctgtcctgtgagccgccagcatggatgacatctacaaggctgcggtgagggacagggctgggtagggctggggtgggcaggcccactgggggctcactcagctgagagtgcggggttagtagccccagggaagtggtggggaccaaggagaaggcctacgtgccttcaacccaggccctcacagggacagtgattctggtgtttgaggatgcagaaggggtagggggttccgggtctgaagggtggtggaggaggttgcagctttcagcatcgtgtctcactctctgtttccaagtgtctgtggtctgtggcactgtcgctcagccacatgtctctgcatttgtctctggacgtttttgcctttctcttttcatctcttcctcctgagctgtctgagtccccattactgtctccctgtccccaacccccatttctgcccctcacattctgcttctcacatgctcaaaatctgccaccccactccagccccttggcgggccgaagatgctttggagggtggagggtgtgagaggaggggtctgtagagcctgagtcctgggctggagatggggctttgaagtttgaggcagggaagttctggacatgagggagaaccaaggaagaaggaacagagaactggggccccagctcccatcatgcctggcaggctcagggctcagtggcttagctaggggtgagagcgagggaatgagggctggagagtggtcaccccaagcccctgcaacctcctgggtcactgagggtcttcagatgctattctatcctgggtggt

SEQ ID NO: 49 - DNA, 50 bp, Homo sapiens
cgcctttggttctggaggcccacaaagctgcgtcagagcactccccaaaa

SEQ ID NO: 50 - DNA, 1024 bp, Homo sapiens
gcagtgccaggccacctgccactgcccacggtgacacagggtagaagccaagagtctggcattttgagacagaggagcaaaaagttctcttcagaaactcctctttcccccacctcttccacgtggagacatcagacacccatagcctggaaagtgcccctgacagaagaaggtcagggtgtttcccatgcagatcagcagtcgggtgggggagaccggtgccccaccacttcctgggagaggtgcccaggcagccacaggccctggggtgagagggctgccaaccactcccctgggctatgcgttagtctccgtcagcttggcctctgtgtcgctgtcactcagataactgtgggagtatcgcggtctggaggtgttgtcgagagggtcgtgctcatcatctgaccgatcaggggcaagggacttccagtagctggtggggctgcagggaccgaggaataaggttagggacaaatgacactcctaccattaagcacgcacgcctttggttctggaggcccacaaagctgcgtcagagcactccccaaaagccaaacattgttaagtaaaaaccttccttggcttacttagaagatactcaaaatgctaagaggaaggagactctggaagcttttaaagctccgaggaaagggatgctgagagcagtgagtctcggactcaagcgtgcataagaatctgatgcaggttcctgggcccttcctcttagaaaccttgaatcgctggcttttgggtacaacccagtaattctgcattttcagtccttccccagaaggctctgaagcaggcagtccgtgaaccacattggcttggagactggaggtctggtgagtacaacttgtctagggtaggggctctcttaggcgagtgattcctaaaaagattccttctgaggaggaggcgctttccctgtcaaatactcccagatctgaaccctttcccctaatgatggctccctgaggcctgtgagaattttcagctttgaccatgccatcatctactaaca

SEQ ID NO: 51 - DNA, 50 bp, Homo sapiens
cgccattgtcagcttcatctcgcggcacttctacgtggccaagggcaacc

SEQ ID NO: 52 - DNA, 1024 bp, Homo sapiens
catctacatccgggagtatttccacagccacgtcagcggcggccaccccgaggccactcctctccgtgtgatgtacacggaccggccgctgagccagacggacccagtcacgctgcagtactgttgcctgaccgacgaccgccaggctttccgcccgcccacacgggcagagctggcgcggcaccgcgtggtggtcaccaccacctcccaggcccgtgagctcagggtgccggtcggcttcttctcccacattctcatcgatgaggcggcccagatgctggagtgcgaggccctcaccccgctggcctatgcctcgcacggcacccgcctcgtgctggcgggcgaccacatgcaggtcacaccccggctgttcagtgtggccagggcccgggcggccgagcacacgctgctgcaccgcctcttcctgtgctaccagcaggagactcacgaggtggcgcggcagagccgcctggtcttccacgagaactaccgctgcacggacgccattgtcagcttcatctcgcggcacttctacgtggccaagggcaaccccatccacgccaggggcaaggttccgccccacccccggcactacccgctcatgttctgccacgtggcgggcagcccagaccgggacatgtccatggcgtcctggctgaatctggctgagattgcgcaggtcgtcgagaaggtgcaggaggcctacaacacctggcccagctgctggggcggccgcgagcagaggtgcatctgtgtcgtttcccacggtgcccaggtgagcccggccagcccgggacagcccccgaccgcacccctgctgggggagggggagctctccggctgatggacgagcccccgcctcagtttccccatctgtaagagggggctgcagtatttgcctcccagggctgaggtggggctcggcccctgaggtgtctggagcttggtgggggtgccgtctccttgtcgggggtggcccagtcctcactgcgtcctgcgctcatccccgagcttggtgggggtg

SEQ ID NO: 53 - DNA, 50 bp, Homo sapiens
cgcggtattttcagataaacaccagaggcatgactgatgtggcccttgcc

SEQ ID NO: 54 - DNA, 1024 bp, Homo sapiens
acacaagtgacacagctctaaggccagacagtaactgcaggtaacagcccacaccccccttctctgggcctgttttccagctgcccagatctgtctgtagctctatgactgacccgatgatgctacaaggcagctgggctgaggtggttcctaccttccaggccaacagtgcacaaaatgggttccagcctctgggcgtgggtactgcactgctggtctttgatgccacagtggctgtctcagtccctgctgcaggctgacccacccaaccccaaacagttcccctttggggtgcttggtaatgaggctgatgccctggcagctggggaggcatcctctgtgtgctcccacccaccctcggcctcggctcatgctcaggggatgagctttgtgcccagccgggctgtatctacctgccctgctcacaggcctgtcatgttcacattcatgtccagcctccctcctgcctccccagactgagtggtgccctcagacggaaacgcggtattttcagataaacaccagaggcatgactgatgtggcccttgccttgtggagtgtgatgcagccgcggtgagacaagtgagctgaaggaatgcggagggtgggtagccccacaggtgccagctacagaagtggggtaggaagaagccttgtaccacccccaccaggcgaagcgcccacaacgccatttgccaaaggtatggcaaatccgcaaggcccctcggttctggggccagccccatgtggcccctggcctccaccagccccagccatgactcctaccgctctgctctgaaggacactttcccacccctctccttgggcctctgcgaggctaggctccaaggcaggtcacagttggtgcggtgggtaagacagagccatggctcctggtgtcaagccctggccagtctgcttccccccacccccacatgacacagcagaccccacaggacagaggcttcccagaagaggtcgcattcgacagggccttgcacacacacccatgccacaggtggag

SEQ ID NO: 55 - DNA, 50 bp, Homo sapiens
agtggccacaggcagagcctgcctttgatgaggttacagaggcagccacg

SEQ ID NO: 56 - DNA, 1024 bp, Homo sapiens
aggtcaaggtggggaaacagctgcagccaaagattccctaccccagggagggaagagggagctggcttggcctgccttgccccttaggggtaggggagctgtgacagcccatttcccccctttaagccctagatgtaggggtttggagcagggaaggccatcacctcatagaccctggggcaagcatcccagaggcccttccggagcctggacctcgctctgctttccagcccaccagccagctgctgagtcccaagcccctccttgggcttgatcccctgggctgcagctgggaacaggctggagacctggcctgggaagccactgagttgcccccacctgccctgagatcccctgtgactgggctgggccccgatcttccctgggggccaggcccttacctgggtgccagtgaaggccgggtgcctggtccccccaggaggctggtcttggagcaggtggtccggtgctggtggtggaaggacagcagcttctctgctagtggccacaggcagagcctgcctttgatgaggttacagaggcagccacgcctgtgctctttggactctggtgggtggggaggcttcctggtcactaaccgctcaacatcaacctggacctgcggcagtgtctgtgctgactggcgtccccagcttagctagaggcccctgcttccctgtttcccccactgctagccttggggtgtggccccctcttccctctgccttttaggtgcctactctggggaacaggtcagcatcaggcacggggctgggaccagaagaagagagcacacatggcccagagtctgggttctgtggtgagggcacaggtcggctggaggtggactccaggcttgggggaagctgtgggctggcgtgtgtgccatgcctgtgcgtgggtggcacccataggtgtgtgatcctgtgtacctgggtggtgcctgtgagcaggacatggatcttgtcacagaagatggggactgaggcccctggggcattacatggagcgctgagattccctc

SEQ ID NO: 57 - DNA, 50 bp, Homo sapiens
cgggccatatggtgtctgtctggcacaacaatgtgactcagctctgctgt

SEQ ID NO: 58 - DNA, 1024 bp, Homo sapiens
cttttcattctggagggcttgagagggagagtgattgactggaaaccctggaagaagggtctagaacccaggtctctggagtcttcacgtactaaattgccttccctcggaggggtttctgttccttggcattcaaggggaccagagtaagtcatcaccaagaaacaccttccctttcacttgcctgaattaggatgctttcagttacaaacactgcaaacccagctcaaagtggttaaagcaaattgaaacatccaacagaattgttttcaggcaccctgggtttaggtgtcaaaccagtccttcaagattagggttggggttggagttggggttagggttagggttagagtcagtatctgactctctgcagctctcaattcccctttcttttatgttggttttactgtgagactggttagggttggcaaagatgaccccagagcaggggttggcatgtttttctgtagagggccacatagtaaatatctgagggctttgcgggccatatggtgtctgtctggcacaacaatgtgactcagctctgctgttgtagtacaaaagcagcaggacatgatatgtaaatgaatgggtatggctgtgtgccataaaactttattcattgacactgagatttgaatttcttgtaatttttgtgtctcacaaaatagtcttctttcttttttttttaatgtaaaaaccagccgggtatggagactcatgcctgtaatctcaacactttgagaggcttaggcgggaggatcacttgaagccaggagttcaagacccacctggggaacatagcaaaaccccatctttatattttaaaaaaaagtaaaaactattagctcataggccatccaaaaacaggtggaagaggctgctggatttggcctgtgggcactgagcttactgagcttacatcttcccagctcagtaagcctggcagaaggtatctctttcccagtagttgggggaaaagtcccagggtggactctcattggacagacttgggtcacatgcc

SEQ ID NO: 59 - DNA, 50 bp, Homo sapiens
cagaaaatcagatgactctgcttgatagtgccactcccccagtggattcg

SEQ ID NO: 60 - DNA, 1024 bp, Homo sapiens
caaatctttgaccactagcagtgtctctgcctcaatattatctccacgcagaatttctttcaaaattcaaaattcaaaatctatatgctcctgggatatgtaatccacaggagctgactttttagtgtgatttgatcattagatttccaggttagaagaaacccaggtagggtagagaaatgggccctggaagaacaagtcaccagtgaaaggctgaaaagatcacagaaaaggtgggggtggggaggggtgaggacaggaactctttaccttcctcgtgttacccaggtcctgcggatttagctcaggcccctccgggccactggatctgggctggtctgtcagcctaggatccagggctccagggctccagggctccttaccagaaaaggtggaggggggtggccaggaagtgggagggttgttaacctcttctcttctctccagattctcccccgtaaccccatgttggttactctcacaatggtccaggtcccaggcagaaaatcagatgactctgcttgatagtgccactcccccagtggattcgtggacatctgggacaggtctcacttggcttagaaaagcccaggaggcgagcagcaggcccgtgtgggcacctgatacttgttaggggtggagtggaggcaggggctgacacaggtgcccgccaacctttgctataaatgaatgctctttctactccagaatgacctaaaaaccactactcaggttttgttttttatttgtgtgtttcatttggctcctgggtggagttaattgatcctcccattgccatccacgtacccacccctccccctgccacacacagagtcttgcagcagccccttctccacaggcccttggattggacaacagaaatgaacccaggccgccattccagttctccttctcaagtgactcatctacgccttgcaaaatccagacaagtatctggaaacttgaagttccttgctgtagcacttcagatgctcatctgggaaacctaaagcagaaacaaagc

SEQ ID NO: 61 - DNA, 50 bp, Homo sapiens
cgctgcactctgccctgctgcatctgtccacgaggggaacaggatcaggc

SEQ ID NO: 62 - DNA, 1024 bp, Homo sapiens
agcctttgggggactgatgaagggagaacatcttttgggggctagaggaagtgagtggctcctagagggacaaggggaagtgaggggagagagtcaaggggacagggccgaagatggtaaccctaccctagggaggggttgccacagccatcaacaagggatttagtgtccaggccctggtgagcaaagccagcactgcctgtctctccccaaaactgcccccccccttccccatcgctctaactcagcctctgggaacagagccctgagggcccccccatcctggatagggaatccccaccccacccccaagaaaatgggacaccaaggcagccaagtaacccaagaggctacagaatgtgctgatggcagagggggaggggtaactgtctcaggatgggggcaggggtcaccccaagtcgtgcactgagggtcacctcatcccacactgtgctctaaccaacggggtttctgtggccagccccagaggcctgtggtctgcgctgcactctgccctgctgcatctgtccacgaggggaacaggatcaggcccatgctgtgtgcgtgcaggagctaggcagaccccacagaaaggtgtcggggcctggggaagctggaccaagcaggggctccagaccaaaggaatggggaagggtggacttctggggacaggtctgggggaaataaggacagatgtctagacctagggggaaagggagcagagacacagagccaccagggtcagagggaagtccgagcagcagtggggaagagggacagcagggagccaggtgggcggggaccccggcgctgggtgcaaagccacaagttgttgctgaatgctggccttggtgtcagcttcctcagagaagcagctgctctgagctgcccctccccacccctgctccaggatgggggcgtctcttggttaccaccagggcagctgctggaggagccgagggagggtaccaggggtgcaggaaggggaggacaggcaggcagaaaggctggatgagagtcaggg

SEQ ID NO: 63 - DNA, 50 bp, Homo sapiens
cgagaagtaccagctcaccagccagcatgggccgctgctgctcacgctcc

SEQ ID NO: 64 - DNA, 1024 bp, Homo sapiens
aagacacaggggactagctttacgacaacaggacataaaagttaggttagggttaagatggataaatcagacttggtgctgtgaggcctgggccccgctctccctgatgctagccctcccctgacttggaccattaggtcaagttcctgtctgcttcgtctccgcagagctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggtgagtgagggcagcccctgggcttcacgtctcggccccaaccttggccaagctgctatcttctcttagcctcttctgtaaaatgcttatcttctgtaaaatgctatgcttttttgtttgttttgttttgtttttgggtttttttgagacagagtctcactctgtcacccaggctggagtacagtggcatgatctcggctcactgcaacctccatctcctgggctcaagcaattctcctgcctcagccttccgagtagctaggatgacaggtgcatgccaccatgcccagctaatttttgtatttttagtagagatgggctttcaccatgttggccaggctggtctcgaactcccaacctcaggtgatccacctgcttcggccccccaaagtgctgggattatagacgtgagccacca

SEQ ID NO: 65 - DNA, 50 bp, Homo sapiens
cgcttgtatcacatggggaatttggcaaatcaagtccgattcttttgcag

SEQ ID NO: 66 - DNA, 1024 bp, Homo sapiens
aggctaattagcaaccgtcttcccaggtagctgcaacgaaactggtctcttccatgctgttaagcaagctgggtctcttgtttgcagttagatcctggcttctgttcagctgacttagggtaggattattcccctggcattgaggaacacacacggttgagtcaaacagcccaaaccccattagatggcaagggaaaatactgctgtactctgatgtcacccgaggaagacacgggaacagatggtgaaggcaaaagcttcatgcaccacagaaacctcggaatacaactttcccacgtaagaatgaataaacactgaaagaggccaaaaccccaaacactctggtatgaggactgctcttctcaaagccaaaaggtcattgggatggcttcttagaagcccttgcgttgctttttcgtttggtaacggggctaggaaatctctgtgtcaccaggaaggcgagtggccctctctccctctggctctttggcaggtggccacgcttgtatcacatggggaatttggcaaatcaagtccgattcttttgcagtgtagctgcagcaaggatttccagttagtgattttgtggtggctcctatgagtcataattccctgattcttctgcagagagggtggacctaagtttgtccttgtgaggaccatcattactcttggtttgagaagtctgcagtccttggaggacataaaactaaaccccaaaatctgagttcttttttcagagacaaggtttcgctctgtcatccaggccagaatgcagtggcacaatcatggctcactgcagcctagacctcctgggctcaagagatcctcctgcctcagcctcccaagtagctgggactacaggcatgagccaccatgcccagctaattttttttttttttttttgagacggagtctcgctctgtcgcccaggctggagtgcagtggcgggatctcggctcactgcaagctccgcctcccgggttcacgccattctcctgcctcagcctcccgagtagctggg

SEQ ID NO: 67 - DNA, 50 bp, Homo sapiens
cgggttcaggaacctgctggttcctgatacataaatcagacagcctctgc

SEQ ID NO: 68 - DNA, 1024 bp, Homo sapiens
accacattgcactcatcggggtcacagggtttcttccaagtgacccgcacatgcccttcccatctctgtgtgacagtggcacctgcaccagactgcatgttgaggtgtcatctgaaattatgaaataaaacagaagtaagaggtctattagctcatcaaaatgcagttatctaagttcagctgtgaactgccaaatttgaggagtgatccaatgaaacatcttttctttgcaatccaagaagacttaccggagagaactgctcagagaatctgcaacatccggttcctggagacagctaaggaaagaagctggggcgcatgtttctgcccaaagccgggttttggccgaggtgactacacaccccctttcctggctcccataggctaagtgcctggcttcttgagaagcctgcttcttgagaacaaaaaagtgatttaaagcctcatgggagatgagcaatcctcaagacacaagcagaaaaagtcccagtgatacaggaagcgggttcaggaacctgctggttcctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgagtgttcatctgcctgatggtttgagtcccatgttagctgccaggaatcagcgtatcttcgtggatggagagaaggtgcagggctgggtattgtgtttggtcactcttccttagggactggctgtcagtttcaactgcctctttcaaagaggaaggaacattataagttcctgggcccttgggtttccaagactcagccccaccaaccccagtttccaaggaaatgaggggctctaagccaaaggctccagtcacttttctgaccagtcttagggtgacaggccctggtagaagtcttgcttgagtg

SEQ ID NO: 69 - DNA, 50 bp, Homo sapiens
gaaggcggcactctggtggggctgctccaggcatgcagatcccacaggcg

SEQ ID NO: 70 - DNA, 1024 bp, Homo sapiens
cgacagaatgggagtggggttgagcccacccctcactgcagcccaggaacctgagcccagagggggccacccaccttccccaggcagggaggcccggcccccagggagatgggggggatgggggaggagaagggcctgcccccacccggcagcctcaggaggggcagctcgggcgggatatggaaagaggccacagcagtgagcagagacacagaggaggaaggggccctgagctggggagacccccacggggtagggcgtgggggccacgggcccacctcctccccatctcctctgtctccctgtctctgtctctctctccctcccccaccctctccccagtcctaccccctcctcacccctcctcccccagcactgcctctgtcactctcgcccacgtggatgtggaggaagagggggcgggagcaaggggcgggcaccctcccttcaacctgacctgggacagtttcccttccgctcacctccgcctgagcagtggagaaggcggcactctggtggggctgctccaggcatgcagatcccacaggcgccctggccagtcgtctgggcggtgctacaactgggctggcggccaggatggttcttaggtaggtggggtcggcggtcaggtgtcccagagccaggggtctggagggaccttccaccctcagtccctggcaggtcggggggtgctgaggcgggcctggccctggcagcccaggggtcccggagcgaggggtctggagggacctttcactctcagtccctggcaggtcggggggtgctgtggcaggcccagccttggcccccagctctgccccttaccctgagctgtgtggctttgggcagctcgaactcctgggttcctctctgggccccaactcctcccctggcccaagtcccctctttgctcctgggcaggcaggacctctgtcccctctcagccggtccttggggctgcgtgtttctgtagaatgacgggtcaggctggccagaaccccaaaccttggccgtggggagtctg

SEQ ID NO: 71 - DNA, 50 bp, Homo sapiens
cgtgagcttgttggtagttcaaagtcaagtcccttggccaccgtctcctg

SEQ ID NO: 72 - DNA, 1024 bp, Homo sapiens
cctgagagagcagatgacagaattgaagagagaggaggacccgtgaacaggaaaggagaccctagtgggggcagtcatgaagggtgaggagtaggaaatactgacacacagagacgggcaaggccacttgtctcctgccagccctctgtgatggggacagctgtggcctccgtaacctgagtccccctacccctcccagctgtatttatagccctggcctagcccagtccctgcccccagatctgagttccagggacaggaggtcatgggcacgtgtgttgggggccatgttcctttccccccattctagggcctcaatactgacatcactctctcaccagcacgtatcattccagctggaaacaccccgcaatcgaacccccagtccttccgtcccaggagtctctcccctctgataagtctcttctgcctcccccaggtgccccaggctcccccaaaaacctgctaaaagtctagcctttgtctttgcagctgccaaacgtgagcttgttggtagttcaaagtcaagtcccttggccaccgtctcctggccagggagagacccctcactggtcccctccccagctgggaggaggaggagcaggaggcaggcaggcggggactgacccagaataactcagggctgagagtaaatttagctggagagaggggaggggaaggaccctattggctggggaatggggagggagggccccagaggggggtcagggggctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggct

SEQ ID NO: 73 - DNA, 50 bp, Homo sapiens
cgccaaccgccacccaaagcttcgtggagtgaggtctttccactggcctt

SEQ ID NO: 74 - DNA, 1024 bp, Homo sapiens
agctcgggccgggttccccgaagtctcggaacatgcccggggctggcggctctgcggggtacacggctgctgggttctgactcacccgcgccgtgcggagtcttttctttttatgaatgaaaagttctcgggctgaaccactgcgaccgcggggggtgggggcgttgcagcggcgcggtcacctccaggctccacccccgagacgcgccgccttggcccgtcggtcccgaacttggcgacgcctccccaagtccggctgcagccttttcaccgggatgggcccggctcggcgttccccggaggctgcgggcccgcccccctgacgtagctgcccatacatggtgtaacttcctcgccgcgcccaggtggagccccgggttcccctgcggactgacgcacctgccagagcccgcgccccgccccagccctctcgaggcctgggctaacctccgtttctgctcccacaaaatagcacgaaagaatcacatctctaggagccacgccaaccgccacccaaagcttcgtggagtgaggtctttccactggccttgttttaaggcttcgagtatatgaaaagtgaataaatgacaaaccagggttacaaaaatggtggcatattttattttactttatatttttgagaccgggtctctgtcacccaggctggagtgcagtggctcgatctcggcgcactgcaggctcaacttcctgagctaaagggattctcctgcctcagcgccccctccaagtaagtgggactacaggcgcgcgtcaccacacccaggtaatttttgtgttttttgtagggattgggtctcgccgtattgcccaggctgggtggtatattttaaatgtttgcgataaggtaatgctttgaactaaccccacataaaatgcaatataatagtattactcaggataatttcaggagctataacgagttttaattcagggccactacaggtgtcctgaggtctgataaacgccatcttcattacggtcagtgcctttcggaggcttgtgg

SEQ ID NO: 75 - DNA, 50 bp, Homo sapiens
cgtcctaatgattcaggctgggcctttctggactttaatcagtttctctg

SEQ ID NO: 76 - DNA, 1024 bp, Homo sapiens
cagtggaaactctatctgacccctctcggcttactctccaccttatgtgggaggtgctgagacctgaggatccagtgcctgtgctgtgtcaccctgagctggttcctctgcatccagctggtctcccacacccaggttttggccagctgcccagacatgggagcggcacccaggctgtggggattggctggcccagcccagcccagcctagcctcccacagccttccctacatcaggggccaggggaaaaaacctcccagaagaaggggagaggaggttgtgtgggacaaggtgctcctgacagaaggtgccagggtgggggtggtgggcctggggcatcctagcctgtgatggagatgggcactgggcaagggattgggcgcacacataggggagccccagccttcccacattctccattgctgcccaaggcccaggcagctcctggttgctggcttggaggatgagtggttttctaactgaaaccaagcccctggcaacgtcctaatgattcaggctgggcctttctggactttaatcagtttctctgtctttctcaatctaagtgcttaccgggtaactggaggccacttggttgctggttttggctgggcctttctggactttacccctcagcccctgtttatccatccctgtttactcttactgttctatctccagcactgcccgtctctgcctctctccactgtccctggagctccctgggcccttccctgggcctcaggacctcactcaccaccccatctgccctgcaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctggtgagtgtggcagcaggacgggtctggggtctcagggtggatggacttc

SEQ ID NO: 77 - DNA, 50 bp, Homo sapiens
cgtgacccagggcagactggtagcaaagcccccacgcccagccaggagca

SEQ ID NO: 78 - DNA, 1024 bp, Homo sapiens
ccctcccgccctcacatgcaggtggatgtcaatgcgtgcacgcacccaggttttcttgcctgttcccacctctttatcctccttggctggttcctccgctccattctctggctcaggaatttgctccccagggtttttcattccgctctgtagcagaatgtgctactgttgctttccagcatcaaacttttcactcccatggcctctgtgttcttcttcctaatgggtgccctttctgcctggcgctcctggaggccgggcccctctcccaagtgtgaatctgatggaagcaggtccttctcgccgggacctcatgtgagaaatgacatgtcccacctgtctcaaggggccgctctctgacatcagagctgctgtagagcggagaggggcaggggtgaagggccacggtggtgcaacccaccacttcctccaaggaggagctgagaggaacaggaagtgtcaggactttacgacccgcgcctccagctgaggtttctagacgtgacccagggcagactggtagcaaagcccccacgcccagccaggagcaccgccgaggactccagcacaccgagggtgagtgtgcagaggccccgctatgtccacggtgatttttggagggaagcactctcctgccccagcctggagtgaccctggtggccctgcttatagccccggcccaggggtgtctggcaggaaggggtctccagaccgtctgctccagggtcccctttgagacccggcaaggggaagtgcctgccaccaagagcagagccacatggtgtgctgggagcgcttgcggctgaggatggggccggcatgggaggacaaggggctgtgaggccggcaaggccaggaagaggctgggcccacaagcccctagggggacggctggggggtcctggtgctccgggctgggcaggaggcaggttcccggggcctcctctgtgaacctgctgcgcctgcctgtgttaggccctcctgtctgcatgctgccccgcctggctacagcgattccatctcc

SEQ ID NO: 79 - DNA, 50 bp, Homo sapiens
cgaaagatataaaagaaaggggaatgtctatggagagggaatctatacct

SEQ ID NO: 80 - DNA, 1024 bp, Homo sapiens
atttagttctcacaacatcagatgaatgggtactactgctatgatcctttccatctaacagatgaagaagctgaggaacaaagaagttaagtagctttcccaagcccacacagccagcaatttgagaagctaaaaatcagaacctcaagctatcattacactccactgtcccctgagctatgctaaaatgcactttgcagaccccatacttcaggcatatcgagaccacccctcatcatcagagctggcagacaaactcaggtgcagccagtgggatttaatgtacctaagaggtgcgtgtgcatgtgtgtgtatccatacccacattttcccaaagaaattgctgtattattatgtctaacactttttatcatggctccaaaggaatcatcacatcctaaagagaagccatgttcacagttaaatgttccaaacctctacatagcaaccaaacagagacctttgcagacatccccagtagtccactgggaggcattttaacgaaagatataaaagaaaggggaatgtctatggagagggaatctataccttggaggcttcaggctttggcagacggctttcctcccaagtccaccttgtcgcaagtaggagacactcagaaaagatcactacagcatcttttcccgataacggaagcctccacagacttaacgttatctttgccttatgcaacactttagaggacttggtgaaagtgttttgcgggctgactgaccagtgtgctaatcacatctgcatttggggcctcgctgatccattgtgtttccccagggcttagtgatgattaggaaactggtgtgagggataactgtcttctggctttcagatgttgcttaacacattgctggaacaggaaacacaagcaacaatatgggtagacaagtgggaagaggttgtgggttggaggtagaacagtgttaggtgcatagcaagaagagacaaagtcacactgtaagagaagcatctggaggagggaggtggtcactcaggcacttattttaca

SEQ ID NO: 81 - DNA, 50 bp, Homo sapiens
agaaagtgaacaccttgggggccactaaggcagccctgctaggggagacg

SEQ ID NO: 82 - DNA, 1024 bp, Homo sapiens
aagagcagacaaacaggaacagaagttctcactctaggtcacgggtttcatttgggaccagtagcctagtctttcagccttcaggctgtttttggcttgaaggtggggtttcaccagggacctgcccctatctgcctaggcatttggctgcctcctgtcattatcaccagggaggtgcctctacctgccaaggttaccctggctctagaagcagaactttggccagaagctgccacagaacaggggtgggagagagaagaggagctgggtgacagagcagaagcattttggggaactgatccttcaggcagcagctgatgtacttcctctctcctccacactccacccctactcgccctctctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggtgagtggaggtgcctctttccgggcctcctctgtgcatttgttattatgattctcaaccccattgcatttcggaaacctaacctctggggagattgaaaagaacaaaagttgcccaagctccacccctagacagcctgatttaactggtctgggaggggccccaggcagccagttttaaaagctctccaggtggagagcaggtgaggggcagccagggttgcctctttctccatctt

SEQ ID NO: 83 - DNA, 50 bp, Homo sapiens
ccaagatcggtctcactgtaagtctgctatctgtattttcccattcttcg

SEQ ID NO: 84 - DNA, 1024 bp, Homo sapiens
aacagaaccatgtccaggacttcatccgtgggacaaaaagagtgaatcttcagtaagtctgtgtgcagagaagcctgagatgatttacctcatttctaagctactactgtactttgttgttgttgttgttgttgttttgagacggagtctcgctctgtcactcaggctggagtgcagtggcgtgatctcggctcactgcaagctccgcctcacgggttcacgccattctcctgcctcagcctcccgagtagctgggactacaggcccccaccaccactcccagctaatttttttttttttttttttttttttttttttttgtatttttagtagaggcggggtttcaccgtgttagccaggaaggtctcaatctcctgacctcgtgatccgcctgcctcggtctcccaaagtgctgggattacaggcgtgagccaccgagccggccaactactgctgtacttcttaccccctgtatcaaagagttaaaatctaattttttcccaagatcggtctcactgtaagtctgctatctgtattttcccattcttcgtctgatagccaccgacattaatgaccagctcattacatgttgaggtgtggggagatgggggtagaaccccgtcaacccaggattcgagtttagaaagactacaagccccaaaatgcaatttcacctcccaaaaactaccattcccaacatgcaatgcaaccaggacgagccaaggaaaaaaagtacaagtgtggctgcaaagtttgcccctcttgttaccctcaggcaaatgattgatttagaaaggccccaggggctattttttgcaggaacggtcactccctaaatccaggcagggaaagggaggagtctgagccgagtcacgccccttctcctgtaaacttgggtcgcctctagcttagcgagcgctggagtttgaagagcgggcagtggctgcacacgccaaactttccctatggcttcggtgaccagggccgtgtttggagagctgccctcgggaggagggacagtgga

SEQ ID NO: 85 - DNA, 50 bp, Homo sapiens
aatggagacacaagcaccgaggagcccatgctgaatgtgcagaggatacg

SEQ ID NO: 86 - DNA, 1024 bp, Homo sapiens
tggcgcctcacgcgggtgcggcccgactacacggcgcaggtgcgtgcaccccgtccgcaccccgcccctgcagccgcctggtctccccgcctcccctcctccctgcaggtttgcgtggctgaggctcccacctcctgacctcgggggccgagagctttgcgagctgaccccgcttccttctggctttgcagaacttggaccacgggaaggcctggggcatcctgaccttcaaaggtaaggctcgggagagcgggtgcccggcagttcgatgccgaccgccgacggcacagcaagtgtgtgcagacgcctctttttcttcatcagggaagactgagagcgaggcgcgggagatcgaacacgtcatgtaccatgactggcggctggtgcccaagcacgaggaggaggccttcaccgcgttcacgccggcgccggaagacagcctggcctccgtgccgtacccgcctctcctccgggccatgattatcgcagaacgacagaaaaatggagacacaagcaccgaggagcccatgctgaatgtgcagaggatacgcatggaaccctgggattaccctgcaaaacaggaagacaaaggaagggccaagggcacccccgtctagaatgccagaaccagcgggtggccttaggggctgtgaggcagtggggaccttattgatgaaagaaaccgtctttgcgttacacccgagtctgcctctcggagcagggagctcaccttccgcgacgtgttctgagggtctgcatcttaggggggagggctggggcaaatcgccacctgtgcctttcctctggccctgctgcccccacacccaactccgagggcccacgctggggaaagcgggaagcgctcgctccctttcccccattagtgctctctctgcctggatcccggcagaagctatgaaagggaataaagagaaaagaagtacccagggtcgtggtgtctttgcgctctgtctttaggaccggggagagaagggctgacgctgtggtcgtggccctggccggg

SEQ ID NO: 87 - DNA, 50 bp, Homo sapiens
ggtgtggcattcaccatgtgctgcttccggataccactccacctggttcg

SEQ ID NO: 88 - DNA, 1024 bp, Homo sapiens
ttgtttgtttttttgagacaggatctcactctgtcgctcaggctggagtgcagtggcagtggtgtgatctcagctcactgcagcctcgacctcctgagtagctgggactacaggcatgtaccacacttggctaacttttttgtagatgagttccgctatgttgcccagacagggcttgagttcctgggcttgagcgattctcccgcctcagcctcccaaagtgctgggattataggcaagtgccactgcgcccggctaaaatagatcttgaccaatgaagtttgtgacaccagctaattgtaccttcctgactttcactgcttcttccaccgacagggggccttcttcaacaactgatagattctcctccctccctccacaaacgttggtgtcttcccatagtgatatcctttgctgaaaaatgatttagacctctctccatccacctccctgccaccatcaagccccatgcttcttacctggcctcgagcaatcttgaagggtgtggcattcaccatgtgctgcttccggataccactccacctggttcggtagtccacaatgtggcaggggggaagaatgtactcgtcataaagcacatctccgttgtagttgacaatgctacatcgagccaaggaactaacatgcccctttggtcctgtgcccaccatctcacagtcaattgccaccatcttccgtggcaacttctgggatgctccggagcatttattctctgaatgagcttgggtggagttctgtggggcattcttctgaggatggttctttttagaggatttcttctgggagctcttcttctgagagcgggttgggtggctattgatctttggaagggcactctggaactcccccagcaaatctactttagcagcaacagaatcagccttttttgaaggggcaggggtcaaccaagacactgcagctttcttgtccaggggctgtcctgacccattgctggaagcagctgtcttcttttttgggaaggaaggggtcttccaagtgccat

SEQ ID NO: 89 - DNA, 50 bp, Homo sapiens
cggctggctgattatcaggcccagaatcacgggcttagaaacattaacag

SEQ ID NO: 90 - DNA, 1024 bp, Homo sapiens
aattagccaggcgtggtggcacacgcctgtaatcccagctactcggaagactgagacacgagaatcacttcaacctgagagacaggttgcagtgagccgacaacacaccattgcactccagcctgggtgacaagtgcgaaaccacgtgaaaaaagaaagaacaacaacaacaacaaaaaacaagggccagatagggtgtcatgcacgggtagtcccagctacttgggaggctgaggtcggaggatcgcttgagccccaaattcgagaacagcctgggcaaaaccctgcctcttaaaaacacccccaaatcgtaataacaaatataaatccttgcactcaaatggacagttcattacgtggtaccgcgtcctgttgcggatcaaggccacctgagttggttaggacagctaagcgggacgtccagggctgctcgccagcggtgggtctagatatgaacttgtgcttgagcagcccagcgtcttacaactctgctgtgaggacggctggctgattatcaggcccagaatcacgggcttagaaacattaacaggaagtacggtaccgaaaagtggaaactttaaggtgcttattattttcctcctgccttgttcctgtatgtgccgcttcaccggtatcacgtcctgggtctggtgggaccccggcctggctgccctaccggaagctaagaaaactcctcccccaggggtggccgtcgggcctcagcccggtctacagcgggagaacgtggcccatgctacgggtaactggttgggcccctggtgcaggtctagggcctgcagccaggctcggggcctccgggggtgcccgctggctggggtctgaggcggcttctctcgggtacgggaaggcggactgctgtgcagctgcgggctcgctcgggaaacccaaagtcacacgaaagcggcagcaccaccgcggctgggatatcgtctcccaacatggggagacaaaatggccgccacgccccgagccgaaattacatccgggctccgcgacacgcccg

SEQ ID NO: 91 - DNA, 50 bp, Homo sapiens
cgtgaaaaaattaaaagtggtaagaaaattgcttcgggtcaaaaatgtgt

SEQ ID NO: 92 - DNA, 1024 bp, Homo sapiens
aggaattcattcattctacactcatttgtggagaggtgacagtgccttctgctatgagctgggatacctttttcacattttcccatatccaaatatgaccaatcattgatggcccagctcaagggtcaccaccgattcccctttccctgccctcaccacccacaccttctcatggcacccatgccattctgccttgtattacagttatgtggatgaatgtcacctcccctgcgtgtctgaatcctctgtgtaattcctactcagctcaacactgcattttgcagaggaggaaaaacaactccctcgattgcttggaaatagaacatttgctggtctaaatcctccagacaatgagctccacgagggcccgcactgcccgccctcatcgcgcacagggaagctgttcaagggccatctgttgaatgaatgagtgaattaatggcttcactcctgtactcttccttacgcgtctttctcaccatatttagcatccggctctctaacaacgtgaaaaaattaaaagtggtaagaaaattgcttcgggtcaaaaatgtgtcatgcaaaagccaccgcagagccggaagcgtgacagcgccgcagaacgccctggcctccccgcccttccccgggcgccgccctgcccgggtccgcgctcgcgcccagcccccaccccgcctcctgggcagtggaggtccctgggggcccggccaggccgccttaaaaccggcgtcccccggcgtcgcggggtcgggcgggggcagggaagcccggcggggagccccccgcttctctgagctcctccttgccgatctccaacggccggcgcgggccccacctgcgccccacgcctcggcaccgcgccggcccggcccaggggcggggaagcgtccgtgcgcccagagtcctcgaggcccagccgggggccccgccggccgcccgtgcccgtcccagcccgcactcaccgtcggggcccggcgctcccgcggcgccgcgggccaggccgagcagcagcaacagcggcagc

SEQ ID NO: 93 - DNA, 50 bp, Homo sapiens
gtgtcgcttcactccctctccctgtgccaatacagcagaatagagttacg

SEQ ID NO: 94 - DNA, 1024 bp, Homo sapiens
ctccatccctcccaccaagatccgtgccatcttctgcttggccccttcccaaagctcacactgtctgtaccacccctaaggatctgtccctgtgctgcctctgtctctccaccccttgagcacaagtctgaagttccagaaagcaagtcctgtccacaataaacttcttaaagaatgaagataaccacctagtattttcagaataaatgatttgatctgagagaaatcttccaactgatgtgaaagaatatcacacttcagcccccacttctgaaagaagagcttagactttctgaccaaatcatacccaaaatctgtttggttttgaccacaatggagacaaagtgtgtgataatgctacagtcaaaatgtctccgcaggccttttgtgataatcagaattctgggatagtctcctgtctggtcacagagcaggcacctggacaggctaaccctccagccctgagaggtaccagggagctggtgagggtgagggcttttgtgtcgcttcactccctctccctgtgccaatacagcagaatagagttacgcttccgcacccaagtcaactgtgtttagcccataaacttcacagccagtgaaatatgacacacctccaggcaccactggacaaaaaatgtaaggaaaatccacaagagagaatgggacccactggcactggtgatcgattccgtgtgaacggagaggacatccagggagctagaaatagcatgcagagacaaaactgactcaagactgactcaagaggacttaagccgagtgacctgtccactctgcaagttctatataggtcacaaccactggctctgcttcctgtactacacacggaatcacacgagtagatgttcaccgggaagagaaacactgaggtgttgaaagacgaagggggatcacgagacacagcccagtctaccctcggccaacccccccaccccccaggctacaaccgcaactacctgcaacacgtgtgcacccaccaactctcaagttccctggactgtaga

SEQ ID NO: 95 - DNA, 50 bp, Homo sapiens
ctcagccaaatggctttcattagtttttatggttagaccccaggtcctcg

SEQ ID NO: 96 - DNA, 1024 bp, Homo sapiens
ccgcagcacacacccagactgcagcctgaagagttggagcattgcattcacagaaagcatccagacatgatcatgggctcagggatacacctgttctccgatgtgtaccagtgaaggatggaaactcctatgcctcccagaaagcaccactcaagcttttgctgaatgcttctctgaaggcccacaaggcctgagaggctgtgcaacaccagcagtaaagtgaatgcccagactcccacctcctttcttgggtggccatctggaaaggccactcccaccctgatggctaatgcctcagaccagttcttggcccagatgatcctagacaattgtttaagcttaaactgttcattggccaagcaaacaggtgatagtcacctctggggaaccacatgccgcgtgtacatccagtactcaggagaacccaaaaatgtctgttccacatagcaacagaagcccaggtagcactcagtctcacctgggtgttctccaacatcccagctcagccaaatggctttcattagtttttatggttagaccccaggtcctcgggacactgctttagaaacacattccaaatcctcctctgtgtgcaggtggcattcctatcccaatctctttgcagggcgtatactgtgatacgcagccaggctgtcccagaggccttaaatattcccttggtgcaggtagttcagcttagccacagccaatgcatcacagggtcaactgtgttaggagccattgagaatccatagttggttgctgcctgggcctggccagggctgaccaaggtagatgagaggttcctctgtggagttctactttaacctcaccttcccaccaaatttctcaactgtccttgccaccacaattatttaatggacccaacagaaagtaaccccggaaattaggacacctcatcccaaaagacctttaaataggggaagtccacttgtgcacggctgctccttgctatagaagacctgggacagaggactgctgtctgccctctctggtcaccctg

SEQ ID NO: 97 - DNA, 50 bp, Homo sapiens
cgagcaaagggactgtgatgaacacaatgtcatggctcgttacctccctg

SEQ ID NO: 98 - DNA, 1024 bp, Homo sapiens
atgtccccaggtcttatctcagttcgctgtgggaggcgaaggcacagaatcatccaaggacaccaagcacctgaggacaaccagaacctgtgggttctgaaggagcagccttcaaagctagtggcagagggtagctcccctcctgcctgtggcttgtgctggcctagagagtatagggcagaaggatggcagatgagtgactccacatccagagctgcctccctttaatccaggatcctgtccttcctgtcctgtaggagtgcctgttgccagtgtggggtgagacaagtttgtcccacagggctgtctgagcagataagattaagggctgggtctgtgctcaattaactcctgtgggcacgggggctgggaagagcaaagtcagcggtgcctacagtcagcaccatgctgggcctgccgtggaagggaggtctgtcctgggcgctgctgctgcttctcttaggctcccagatcctgctgatctatgcctggcatttccacgagcaaagggactgtgatgaacacaatgtcatggctcgttacctccctgccacagtggagtttgctgtccacacattcaaccaacagagcaaggactactatgcctacagactggggcacatcttgaattcctggaaggagcaggttggtgaccacgtaccctcctgccctggcatctggcatgtgctgctcagtgaaaaatgggagtggggtggggacagggggtcttattgaagagtcttgttcaccagttgtagtccatacttaagaaaatacaaggtagtttagttagtttttgattttgaaaacatctaagttagaaatttcaaataatttgatcctaatcaactctcatgaaaaacatattgtttaatctccatctttttatgacattatttaactgaagaatgacttcaaaatgaggactaccaagaaaatgaagatacggaataaggaaaagggctgaacagaaaatgtgaatagagagaaattgagaaatacttccaaaaaatgtaataaaaaa

SEQ ID NO: 99 - DNA, 50 bp, Homo sapiens
aagaatcaaccatgggttcctctgggtgaggggctctggcactgtccccg

SEQ ID NO: 100 - DNA, 1024 bp, Homo sapiens
gagacacctcatacccacctcattcaacccataggatacttctgatgaactaaacagaactggccttactgacccaaatgacaaatctggggctgagagagggtaggtaatttactcaaggccacacagcaaggaaatggcaggtcagcaggtcactggcagcatttttatttcactgtgcaatacatgtcacacatatacacatactgcaagccccactccattcacatatataccccttgtacaggtgagtcccacacaaacttaccacttctcagcctgttgtgggtggagagctgaagagcattttcagggcagttccagcgttcccaagcaaactggaacttgcactcctcgatgccactctgggcacccaaggccacactagtcgtgtaggtcagataggcctggcaaagggaaaagggctgtgagcttctgcccggtatgggtcatctgtggttgggggagcaggcaggactcagatgggccagctctccattaagaatcaaccatgggttcctctgggtgaggggctctggcactgtccccgcccctcttttctccagaagagtccccttagggccctcagtgggtaaaaacagaagctggagatcatcctaccttgggacctgttatcaggaaattgttcactgacctaccaaaaagagaaaaagtgaggcagaggtgaatggggatgagacaatgggggcctccttggcaaggagtgagggttgggaaaggacttaccaggcagaggcactgaatgcagcacagcatatgcccagagctgcccagagcataaacaggttccccatcgccctgcctaccccagtggaccaggtccagctcagggccaagtccagagaagtgaggagagggcagggtcttcctcagtatttatgtgagaaaattctgaatgtccaagggaggaaatcagcagctcttctcatttgttcctaactggcagggctgcaggagccaccggcccagtgggggatctgggaggagggactcagttttcgcc

SEQ ID NO: 101 - DNA, 50 bp, Homo sapiens
aggacttcactaatctgcctaaaccttgacctgaggggcctctaagggcg

SEQ ID NO: 102 - DNA, 1024 bp, Homo sapiens
actctagttagaatggatgcttcactttcagcgaacatgccccctcctccaggaagccctccctgcccctcctcacctcctcagatcatcctcaaagggcaggaaaagccatttctttggcatgtccttgaggaacaggtcctgctgctcctccgtggagtcctgggacacgtacaccagggccagctgagccgcccgcagtacatagaactcatctgtgagccgcacgaagaagtccttgaggatgggcacgaaggcctggcactgtggacaagccccagcaccaaagaacagcagcaccagccggttctccagcctgcgactgacctcagcctccgtatccagctcgtcctggtcgctattgttgcggatcaggatgcggccagagaacagggaggccatggtaacctgggttgggtgctggggacagcgcggcgtgtggtccccggtctgctgactggctcctctcccagaaatagaaatctttagaaaaccagcttaggacttcactaatctgcctaaaccttgacctgaggggcctctaagggcggggggcagggctctctgtgtggcccttctcaggagagagccgcaaacgcattaagaaaacacgtaacagatgggcacggtggctcacgcctgtgatcccagcactttgagaggcagaggtgggaggatcatctgaggtcaggagtttgagaccagcctggccaacatggtgaaaccctgtctgtactaaaaaataaaaaaattagccaggcgtggtggtgggcacctgtaatcccagctacttgggcagccgaggcaggagaatcgcttgaagccaggaggcggaggttgcagtgagctgagattgtgccactgcactccagcctgggcgacagagcgagactccatctcagaaaaaaaaagaaagaaagaaagaaaaaaaaccaaaaaaccatgtagcagacagtgactcacgcctgtaatctcagcactttgggaggctgaggcaggaggatcacctgagaccaggagtttg

SEQ ID NO: 103 - DNA, 50 bp, Homo sapiens
tgcagatgcctgcttctgggactcaatgcactgcaccctggtcatctgcg

SEQ ID NO: 104 - DNA, 1024 bp, Homo sapiens
atgcctggatcagggaagagttcaaggagggggaagcagcatgatgagtgggccttctcctgactttgatccacctgccaccttcttttcctcatacccagcctctcctgtctattttagggtacaattgcccagaaagtccttcctaaagtctaacttaaatcccttcttcagctccagctgttctggcttccagagactctccttcctttgccctctgggtcctgagggcttttaatccagcagcagtgagctgtcacactgtgctctaggaggggcgggaaaggcagcacagccttccagatggacagagtcattccctggcctggaggatgaagaaacatgatgcaggaagtcaccctagaggccagaatgagggagggcttacttcataatatgagggactgacctagttcgcagggaaaattattgactgggcaggagagaaggactgagacgggaatgtggaatgcactgggcaaatggtcactgacacagagtgcagatgcctgcttctgggactcaatgcactgcaccctggtcatctgcggactcagcctgagcttccagagggcctaggagcagtaagggagtgagtgggcaactcggcgcatgaaggaggtactcctcattttcgttctctctctctgtgccccagcccgttggcagacccggatcattcctgccttctcttggagtggcctttgtccatctgcaagtccttccccatgggagggtgggagagatgagggagctgcaccacgctgccgccccaggtttccactcaccgcagtgtagcccaggttctggcagctcctgcgggtcatgtctgtgatctggaaggtgctgaaggttgggatgggggcttcgtgactccctgtgagcacaaagagggctgccggggtttctcagagaggaactatgtctgtctctgcctcccacccctcctcccaggctcaggggatctggagggctgggacagtcttaacgacaggaaaaacgcagaagggcagcaggggagttt

SEQ ID NO: 105 - DNA, 50 bp, Homo sapiens
cgaggtggatgtatatttgaactgagacatgaaaagtaagaaagactcag

SEQ ID NO: 106 - DNA, 1024 bp, Homo sapiens
acagggcccaaggaagaggggctcagtgtggtggccctgagggatatttggcaaagggcaggacttgacttaattatccgcaccatttctagagttcttcctttcctttcctttcctttttttttttttttttttaagccacagtctctctctgtcactcaggctaagtgaagtggtgcaatcacagctcattgcagcctcaacctctcaaactcctggatgcaagcaatcctcctgcctcagcctctcatagtattgggattacagatgtaagcccctgcacctggcctagagctcttcctttgtgcctggcagtgtgccagccttggcacactgagcaagacagacataggccctgtcctcatggagcttacattccaatggaggagattactgacaaataaagaatattgcaaattatgctaagtgccataaaagaaacaaacagggcagaagcatgttgtggagggcagtaggggcaggtaggcaggcccctatgacgaggtggatgtatatttgaactgagacatgaaaagtaagaaagactcagctgtgaaaaaagctgggtgagtggtgctccaggccaaggacactgcaacgagaaaggttctgaggctggaatgagccttgaggagcagaatgggaaccggggagcctggagcttaacgggtgcaggggagagtggtgggagatgaggttgacagagggcaggggcagatgttgtgagactgtaagccacaggaaggagtgtagttttagatgatggttttgaacaggggctgggcatgatctgtgtggctctgtgtagcaggcaagcatggaaacaggaaactggtcaggaggctgcggagggacaagctgattggtgactggatgacccctggcttcccctccagtgttgggcttcaagacctctgataatgcaacctctacatggcaagtgattcacaagaaagttctttctgccagcaaggccagaccccaacggtaaagctcaatgtactccctgacccttccctacaaa

SEQ ID NO: 107 - DNA, 50 bp, Homo sapiens
agaagccaaggtgccacgaagtacagcagaattgcagtcctagtacctcg

SEQ ID NO: 108 - DNA, 1024 bp, Homo sapiens
aataacaaatgctggactgcggtcctgctatatgactataatttaatgacaactgcagttcaagaagcctaagaccatccccctcatgttctggatgaaataaggaatccttgcctgagaaactcctttccacgccacagaacctcacctgtttggcggtccagggcctgggtgaactggttaatcgcaggaggcactttcagccgcttatagaggatggctctctgccgctgcaacctgatatagcggggccatttcacaaagcgggtgaggtctcttttgggctggatgtcctgtcctgagaagtaaagggtgacaccgagtgaggctcaaattccatgtcaagttcatgtctggggccactaggaagggtgttggtgcatcagcgatcttggtggtttaaaatgtcatcaccatctctcagatagcaaatattcttttacatcatctgcacacaaacacctgagaacaaagagcacgatgcttttcctcatctaacaagaagccaaggtgccacgaagtacagcagaattgcagtcctagtacctcgctgcgacactgctactgtacttgtttccagatggctaagctgaattcaaggccactaccatattgagctgaatgctcgctcagcaactcccaatgaaagcaagaagcatgtatcattgcccccgtctctaagagacacaaattaaggactgcgaccactttacacccactaaaacctacaagatacaacacaacccaattaccaccttcccttgagaaaaacatagaccgttttcattctgccgtttgttacttaccaatgccaaaattcttaggccttttctcaaacaggggattcaccactttcttagcctcctgcttcttcacgacagctggggccggagccaccttctttcccttggccttctttcctttcggctgggcagaaagaaaacgtcagttaaaccgccgcctccactcgcttcgtcgggggtagggctcaggctggctcctccaaaacaagggacgctgacag

SEQ ID NO: 109 - DNA, 50 bp, Homo sapiens
ctttaggagtcccaggaacagcaatttcagcaagtgcctttgcagtcacg

SEQ ID NO: 110 - DNA, 1024 bp, Homo sapiens
cctgggacctcctgggagctcacagccagacaggtccctgagcctggaggagggggctgtctagaaaggacagggctgtctggatgccacccaggcctggggcctctggctgtgctgtcagcagcttgacaatatttttagtgcctgttgaattttcctggccttaccccagccctgttctatgaaaaagtgagtctattctgtgaaaaacaaagtcctgctagccagctgcttaaatctctttaagtctcttctggaggctgggctgggtccaggtctgcaaatcataaaggaagggcgggaaggattctgccttcctgctggttctggccacattcacagaagccccttggtcatctccctccaacctacactccttgcacaccccctgcctctccccacaccaggggtccctcagggttgtcgcaccgtccttgccctccccccatgacatcctctgtctagacacggtcaggacacaaatctggcagctctactgtctttaggagtcccaggaacagcaatttcagcaagtgcctttgcagtcacgtgaccacagcacaggagtcctcccttcagacagcagaattattctggggtgtgctctccccagtgagctggctggccggttcatgccaccagcactcagctggagcccaggtcatttccagacacagacaagggacagggacttagaaagcagaggccagagctgcccaaaggcatggcctgtccaaagccacaggtactgggggcagattgaggtgggagcccccctgtgtctcttcaaacacacattttagactggccacgttcaaatatgagaactgccatctgctaactgtttgacctgctagcaagtgagttaacttctcagtgcctcagtttcctcatctacagaaagagggtgatgatcataaggtcttcttcatagggttagtgtgaagattaaatgcattaatacatgcaggatgtttcacccagtgtctagtgacaggtaaacactctgtaagggtttgctatc

SEQ ID NO: 111 - DNA, 50 bp, Homo sapiens
gggctgcccggactggaaggcccacatgataggcactgaccaaggggtcg

SEQ ID NO: 112 - DNA, 1024 bp, Homo sapiens
tgcttcctcagccccacccagtgatggagacacagtcagcattggttgtcgttttattattgttttcagagatagggtctggctctgtcgcccaggctggagtgcagtggcgtgatcatagctcactgcagcctccaattcctgggctcaagtgatcctcctccgtcagcctcctcagtagctaggactacaggtgcataccaccaggcctggctatttattttattttttgtagaaatagggtctcactatattgcccaggttggtctcaaactcctggcctcaagtgatcctcctgtctcagcctttccaagtgctaggattacaagtgtaagccactgtgcccagcctgcagttttattatttacagttttatttatttatcagggagaacagggtcggggagatgtgggttcgagacagcatcagggacttacaccattccctgggggggcattgggggtggaggcagatgtcagggagcggtcagatgccctcacgggctgcccggactggaaggcccacatgataggcactgaccaaggggtcgctggccagcctctaagcacagttctgagttctagaaatcttctccagatactttctcctcctaagttctggcttagctagaaccaatatatctgcccctgaggtgtgaacccacagccctgggggattctattgtatcccagtaggaatacagacatgagaagtaggaggccagaacttggcatgagttggggttggggcagaggtggggggcagagagctgtaccaccaataacaagaccctcaggccttgtagaaagcacttctgactcccagatggtgcataccctgcagatacctgggccagggcagagactctacctcctggctccccccactttttttttttctttttggagatggggtcttgctacgttggccaggctggtcttgaactcctaggctcaagtgatccgcctaccttggcctcctaaagtgctgggattacaggccgtaagccactgtgctcagcccc

SEQ ID NO: 113 - DNA, 50 bp, Homo sapiens
atgttgggcttcattgatacggcaaatactcatgaagcaccttctctgcg

SEQ ID NO: 114 - DNA, 1024 bp, Homo sapiens
ttgccactcggggtagcgtgtgctgtgctggagtgctaggagttccactaacgggaatgtttttgagccccctgctacctgtcaggcactgttcaaggaaacttgcctggcttgtctcacagatctcgctgcgacctttgtaagtcaggctctgttgttggtcacattttactgaagagtaaagttagacacaggagacatggctaaagccactcagccagcaaatcgtggagctggggtttgagcctgggcattgtgaccccagaagagccttatccaatctagtgcccagtggattgcagggagaaccctgcctacctcccaccccaaagttgagctccgaccacctactgcttccttgatgttactctacccaagagctcagaagtacccgagccacaggtcggagggcctccccacacactgccacaaactggctccttggccctgagctcccacctaacccctccaggccctggtatccagtgttgtaaaatgagatgttgggcttcattgatacggcaaatactcatgaagcaccttctctgcgccagagaagggggatggatggttataaaactacagagagagttggaagtcccccagaaattctttggtgaatactccagctccgtcagttaattcaagcaatctgaagcccagagaaggaggtggcctacctgtagttacacatccagttaggagactagctcagcctaaaattctgagccttttccctggtggcgctgtctgcttctagaacctctcctcctctgggtcgtaaagccataagactcactctttaatgagtactattatatttccgctgattactacttaatgtgtgccataagcaaaagtcctctgccctcaccactcttgtttttaatttcgagtctttctctaatttacttcatttagcaaataatttttgagcctttgggtataatgaggctgtgctgataaacaagaccctcctctttgaggatttacaggaggcagttttctctggaaaggggaggct

SEQ ID NO: 115 - DNA, 50 bp, Homo sapiens
tttccctttctgactcaaccacagcacagaacagatcattcatgttgacg

SEQ ID NO: 116 - DNA, 1024 bp, Homo sapiens
tgggggtgggggcagggtggggccaggggagaacaaggaggggtggtggggtggtggggggggccgcagcccgggagggggaaagctgtgggtggacaaaggcaggggcagtgagggcgtcgggggccggtgggtgagctgcgcggacgaggaggaggcagatgaggaggaggaggacgaagaggatgatgaggggggaggctgagccacgggaggggccggggccttggggggcggccgtgaagagctggggagagaagtggggagatgagtgaggggttgggaggtgccagctctgacgggagggggtcagaagcctgggtgataccgtgaccctggttctccaacacgggaggtggcagaacccagccccaggaccgccccccaccgagggaatccgttctcagactgaggcgcctcccacacccagcaacccctatttctccctgtctaggtctctgcatccacgcagctgcctctgccatctctggccagatgactttccctttctgactcaaccacagcacagaacagatcattcatgttgacgcttaattagaacaagccacctggggtcccaccctacaacagtggaagcagcaccacactggcctggcctgggagtcaggagacctgaattctaggcccatcttgccatgaatgcccggggtgaccttgagcaagtcactgcccctctctgagccttagttttctcaataataacaatgacaatgacggtgacaaaatagagcatcaatagtaagtgtcaatagttcttaccctgtggcaagcacctgctgtaggccaagtgctggcacctgctttaaaagctaatccaagtctccaacattccacgccaccttccccactgctgcccagcaaagtaaccatctgaactgcatcaatggcttcttttaagaactcaatttccttttttttttttttaacttagcctccccctaagcaatcgcgtgtgaaatcaaggggctgaggcatgacactcagctttctaaagttcacaaaa

SEQ ID NO: 117 - DNA, 50 bp, Homo sapiens
atctcgctggaggctctggagtcactcccaactctgtgctgggaggaacg

SEQ ID NO: 118 - DNA, 1024 bp, Homo sapiens
gagacaagtgttctatccagttctgtctctgcagtatctctgatgtgtatgtatctctatcatcaatgccgactgtctgtacagcaaggccaccatcatccctgtgtacttactgggatcagtataggatcttcacagctggacttccctgaatctgccttgcactctccactgcagccttcacagcacagttctatctctataaattcaaatcttaccttctcattcccctggaacaaattcgttattggatttcattgtacattaaataaattagaagtccttattgtggaatgagggcacaacaggtctcctgatcctaggcatgaaaactctgcagccccatctgtgttttcattctcctctcttccccataattaccactgtcacctcctaagtcccaagcagtcaccgcatcttttcccccttctgttttaccttcacttgaactctcagctgagctcagggccagcagggccactgacagcagaatcagcagcatctcgctggaggctctggagtcactcccaactctgtgctgggaggaacgtggcaactccctttataaagaggagcaaaacaatggcacctttgagccctgggtgggcctcaccacctcagagactgggttctgctttccttactgcaggtcaggtgtatcccttatttctctttgggactctagcccagagggatggggtgggttggatgttgtttgtgccttatttctaaaaggtacgactatgacttgaataaaggttctaaaggaactgtgtccaagctatcagcactgtgtcataattgaacttcagacatcattagagtttcaatccttttggtaagactatgtctgctttccactctactatttatttctgtgtaatatttgtgggggcagtgaagctacagccagcagtgaagatggtcaatttctctggctctttatagagcctatttccatctcttgtgatgtgtgtgtacagatagtatcacaattggctaaagttttgatgcgatagagatg

SEQ ID NO: 119 - DNA, 50 bp, Homo sapiens
cgaggagcaagctttctgtgatgtgtagccacccacatgttgatgggttg

SEQ ID NO: 120 - DNA, 1024 bp, Homo sapiens
ggggcagagcacaggagggtagccctgcaggaactctgctctgtgttccaggtgaatgttcaggcacctctggaaatattcctgggattctgtttccttctgagttttgctgattattttttttctttgtatcagttcaagggcacaggtaaattctgactttggaaggcacaggaagctggaaggctgtgttctggttatgggggagcagggacataaggaaaccctgctttgatccccctgcatgtctgacaaccagtaggcttgtttcagttgcacattgagcaagtctaaacaagacctattcccctcagcccctcccatcaccaccatgttcactgcataggtacctaaaacctagttcaatgcatcttacctttggaggatttcctggggaaaagcaactgctgcacctgttctctagcctgtctcactcccaaacctgagtcttgtttatgagtgcagctataaatatggccaagactcacattttctctctacgaggagcaagctttctgtgatgtgtagccacccacatgttgatgggttgacctgatgattacatagcctaactttttccaagtagcttttggagtgtccagagccaatcatgcatcggacaggtactgagagttctttgctctggggctccaggaggggaagaagatggaaaagaagagacagatgatcagggtgagtggtcacttccccccaacctctaggctcaagttttccacttcaaatctagctgtgcagcctgagccaatcccatttttaatagaaagggaaggaagcacccagacaaagcaatacacaccctcctgccctcctgctgtgatgcctttgtgtggtgtgagcaggaaatcaatcactagaaatttctctctcttttttgttattatactttaagttttagggtacgtgtgcacaacgtgcaggttagctacatatgtatacatgtgccatgttggtgtgctgcaccaattaactcatcatttaacattaggtatatctcctaatgcta

SEQ ID NO: 121 - DNA, 50 bp, Homo sapiens
caggccagggaatgactctgtccatctggaaggctgtgctgcctttcccg

SEQ ID NO: 122 - DNA, 1024 bp, Homo sapiens
catgacccgcaggagctgccagaacctgggctacactgcggtgagtggaaacctggggcggcagcgtggtgcagctccctcatctctcccaccctcccatggggaaggacttgcagatggacaaaggccactccaagagaaggcaggaatgatccgggtctgccaacgggctggggcacagagagagagaacgaaaatgaggagtacctccttcatgcgccgagttgcccactcactcccttactgctcctaggccctctggaagctcaggctgagtccgcagatgaccagggtgcagtgcattgagtcccagaagcaggcatctgcactctgtgtcagtgaccatttgcccagtgcattccacattcccgtctcagtccttctctcctgcccagtcaataattttccctgcgaactaggtcagtccctcatattatgaagtaagccctccctcattctggcctctagggtgacttcctgcatcatgtttcttcatcctccaggccagggaatgactctgtccatctggaaggctgtgctgcctttcccgcccctcctagagcacagtgtgacagctcactgctgctggattaaaagccctcaggacccagagggcaaaggaaggagagtctctggaagccagaacagctggagctgaagaagggatttaagttagactttaggaaggactttctgggcaattgtaccctaaaatagacaggagaggctgggtatgaggaaaagaaggtggcaggtggatcaaagtcaggagaaggcccactcatcatgctgcttccccctccttgaactcttccctgatccaggcatctccccaggccccggaggctgcctccaacacagggaatgctgagagggcagaggaggtgcctggagaaggaagcctgttcctgcaggccgagacccgggcttggttccagaagacccaggcccactggctcctgcagcacggggcagcccctgcctggttccatggcttcatcacccggaggtgagtcatggagga

SEQ ID NO: 123 - DNA, 50 bp, Homo sapiens
cctgaaccatgatatttgacccatttggcaggagctacagaattccatcg

SEQ ID NO: 124 - DNA, 1024 bp, Homo sapiens
ctcctccctcagacccaggctctggcccacactcactttcggggctctggtcagcagcgccccccaccgtcccatcctccctgatctccaggtgggcttctgtctgctgggcatcatctgtgtagaggtaccgctgccggacttggcccccgaattgcaggagaggactggagtcagggatggggtgtgcctggcaggctcccagcagaagaccagccagcacagaaacccacagtcctgagtgctcgaacccggtctcgtccgagtccatcaatggctcgggtcctcaggtgatctccggggtgtgagctcggagaagctgagtggtttagaattggtgccagattccagttgtccaggtgagtagactcaggtggcctgagtgcctggctcctctttcggctggatcctcagctgacagaacacccttgttttttgggatagatgcagaagctccagaatttatacccagacaggcccgcccaatcaccctccctgcgcctgaaccatgatatttgacccatttggcaggagctacagaattccatcgtggcaagggcagcctgaatggatgatgtaacctggggtcctttcaatggagggccagactcctgggtctaggggatgagggaggggaggatcgggttagctgggacccaggtgaaaggggctgggggcccacattcctgagtctcagagagaaggatctggggtctcaagcacctgagtcggagggaggaggggtgctgggctcctggaaaaaccacctcttggaccatctatgcagatcacgcagaacaagagaaatttctgcgccccatctgaatttctaagtttggggggagggcgtgatctgacactgaggttccttgatcctcagcaaggcggcaattgctgtatgaaagaagcgaccgcatctgagacacaagtatcctgccttggaagcctctcacctggccgtgggccaacctcaacctcatctgtccctgctcagatgctcagaccctggacatcccagcctcct

SEQ ID NO: 125 - DNA, 50 bp, Homo sapiens
cggttaagagtttggactgtgtggttggacttcttgggttggaatttcca

SEQ ID NO: 126 - DNA, 1024 bp, Homo sapiens
acctgttggagggaacgctaggtcctccctttggctgtcacttgtccatctgcagcaggcgaggactgtggccttggaccatgggagacctggagttccaccacctgttctgggagtggggcccaatcagcccccctgcttaccttctgccctatattagagccccaggctctgtgcccttttcctatcatcacaaaactcatgatgctccggctgctcagttccctcctccttgtggccgttggtaagaccccaacctgtctgtgtgctccctgggctgccctggactaggaatccttgaaatctaccactcgctctgagtcccatgacatgctatgcctggttccacaggagggggtctcagcttgtacccgggggcatgactgtaggggctttcagcttatgatggagcaggagagtggaggggaagctgtggatggtgaaagacccccaaagggctgtggtggaagtccttgatgggggcagtaaacaaagtcaaacggttaagagtttggactgtgtggttggacttcttgggttggaatttccacagttctacttaccactccaactctcctctcactccccctacctggctccatattctatgctctggccttttcctggtctctctgccatattacattccagctcagggccacctcttccaaacagcctcccttgactgacaataatggtaacagataacattgattgagtgcttactatgccaggcagaatgtttagggattttcttatactttctcatgtaattctcacaacagcctcaggagatcagtactatcattatcccccattttactgaccctcaaggaagtaaagtagcttatcatagaacaaaaggcagagctgcacttaatgtttttattttttgctttttttttgtagagatggggtcttgctttgttgcccagactggtctcaaaatcctggcctcaagcaatcctaccaccttagcctcctgagtagctgagattataggcacatgccaccatacctggct

SEQ ID NO: 127 - DNA, 50 bp, Homo sapiens
gggcaatccacttgcatactcagctcactgtggagagctttcttctttcg

SEQ ID NO: 128 - DNA, 1024 bp, Homo sapiens
gagcatctgtactaggaatgttccatttcttacgtaggatggttttgtcatgggtagtaattacattatgtttcctaactgtgtgcgagagagaaggaaagagaaaatcagttggggaagactcaatgcagaagcggcctgcctgaaaagtcacagcaacaggcaaaaataaaacaacctggtaaaaaactcaggctccacctgcacacagataagcagacagggtccagcacagaagccttttgttctttgtataattagggagctcccaggaaagttttctccccttttcaggcatatacatggtgggaactttcacagggaggaggggggcttacctaaaacaaacccacagttatgcaaacaaaaaaggcggtgctttgtgcttgcatagatacataaccacagctgcgtaagacagctttactgataagagaagttactcaaactactacagagataagagattttcttgcaaaagcttttgaattcagctgtaacagggcaatccacttgcatactcagctcactgtggagagctttcttctttcgcttattaaactttcgctcccacctcaccttatgtcccgttccttaattttcttggagtaggacaaagaatcccgggtatcagtccagacaaggagaaactgctacattaaggtacattggcaagactgcaacatgtgtattccatgtactttttcataagttatctattacgtaagtgtagatttcattttctatatatttttaaaaataaaacaactctgaattgttcaagattttaacccctgattgtgcctcccaaggcttcctaatctggtctccatttacccctccaagtcacgcctctgttccaaaccgttcagcttctccagccactttaggcaccacctctgagcctttgctgtttccatgaccttccccaaaacgaataacctccttcgcccctctccgcctaaaagacccacagattcccgggcctctaagcgccccgtttcgtcccattctgttctcggac

SEQ ID NO: 129 - DNA, 50 bp, Homo sapiens
cgtgcggccttgcctcggctttgcctgcttgtaagacacagtccgcactc

SEQ ID NO: 130 - DNA, 1024 bp, Homo sapiens
cttctggaagacctccctgttggttcctcctctacgcccacccgcctgcccccgcacaagttgccccattccagcctcgctattctccacatctgtggccagcactccgcccaggggcagcttccagaaaccgtctgtccccagttcttttggtcatttctcttaagggccaatagaaatgggagaaacatatttgctgaccaaacgcgaaaaggagttatggagaccagggtctgatcaatttggctcacacaacggcagagatatgaaggaggccggatttcgcccaaggctggatctcaccaccccccatcctccatctctccagttcttcccccactttactcgtgcggttctttcttcactaacatcccggccagtagggtctctctcccttctcccagcgtccgccattccatctcccttaggcccaacctctccttcctacccaggggtgcgttcaggaggccttcctgtccctcctcctctgaaggctgagacgtgcggccttgcctcggctttgcctgcttgtaagacacagtccgcactctctacctccaaggaaccccggggttcctcctgcccggcttcaccctcctatttcccagcgtctccgccccctgccccgcccccgggccggctctccgaggagggggaactgctgtcgccgccgccgccgccgcctcagcttcccacagccgctgccgctgccgccgctctgcctggtccagccaccggcccagtgctctgacttcgccggaccggggagctctgcagagacaccctcactccttcccgagggtccgggacgcctagccgggcgtggggggaagctccgtttgcgggggacagggagggaggagcctggagccgaagccagcgccacccgtcgccggatcaacaggacaggacaggttgaggggcgtcgggaaaaggaagagggggtgctataggcaatcccggggaggacgaggaagccctgtagcaggaagctgtgatccgctctgacttgtagggggcctgt

SEQ ID NO: 131 - DNA, 50 bp, Homo sapiens
cgtgtaggcagaggctcagctaccagtttggacggctgcttcccaccagc

SEQ ID NO: 132 - DNA, 1024 bp, Homo sapiens
gtattgaaaagacacaatataaccctttcttctttcaaatgatctcatagctatttgttgaggggaaataccaaatgtttattattttttttgaagaagcttcttcggtcctgatgattcatgttgatatcattttcctcctgactacagaggctctgagacaaagctacacctcaagtgatatgccagggtcagaacaattcccgtcctgaaggagggtgtgcaaccttctttatccctccttcacagacgtccttgagcccttgagacggatgtgagtgagtttttcagtcctcatgcaaaacaaccatctaaacataacagatgacatcagcttgggcttttcaattcctggatggcagcagcgtgttaatccagccttcatcctggatttcataaaccaaaacaagagagcctggcaggaggacagcgctgctgctgggttgaggaaattgatgacgggaaagcatgcgggcaacccagtgtataaaactcataaacgtgtaggcagaggctcagctaccagtttggacggctgcttcccaccagcaaagaccacgactggagagccgagccggaggcagctgggaaacatgaagagcgtcttgctgctgaccacgctcctcgtgcctgcacacctggtggccgcctggagcaataattatgcggtggactgccctcaacactgtgacagcagtgagtgcaaaagcagcccgcgctgcaagaggacagtgctcgacgactgtggctgctgccgagtgtgcgctgcagggcggggagaaacttgctaccgcacagtctcaggcatggatggcatgaagtgtggcccggggctgaggtgtcagccttctaatggggaggatccttttggtgaagagtttggtatctgcaaaggtaaagagtgaccccttacctctcccctcccggggcatgctgagagcttttagccagcttgggaggtgaggtggctttgctcctcaagagtaagagggaaaaggcaggtggattcttgacaaggcaccac

SEQ ID NO: 133 - DNA, 50 bp, Homo sapiens
cggtgcccgagcctaatcttacatcttggatttgtaagtggcatttattg

SEQ ID NO: 134 - DNA, 1024 bp, Homo sapiens
cttaagaaaagtctaggcaataggccctcaggtagtgaattattctgtaggattcattgttttttgtttcattttgttttgttttgttcttttttcatttttctatttttctccataggattcttgataggtttcaatcacacaccttcccatgggtatttccatgggcaacccaccccttctcttcagcagtaaactaacaactacataccagtgaacatcacaggtataaaccacctttcttcttttaaggaattagtatgcaaactttagtactcttttcctagtaacaaataactgctgtatcagattgtgtcacaaggcagctgctttgacttattgctctgtagctggggtcagcctcttcagaacattgttaatgagagaaaggaagtgctttgggcagtgtctggcccatcaggccctctgtaaatgtttgctattaatgcaatgctgagatcccagtgaacagaatctggcttagaagaagtgggtatccacggtgcccgagcctaatcttacatcttggatttgtaagtggcatttattgagttgaacatgagcttgagcacgcggtcacacattctttcagcaaacactggttaggcaccagctgctacgtgcaagcactgccctacatgctgggacgcagctgtagtaggaatgaaataacgccagcattcctgcatgcgggcagtgcgggccctgtacagaaaggtacacgagataggcatcctcacatccattgtcctgggaggaaactgaggctttgagaaacggagaacttgccgggccatttgactctacgtcatcccctcccccatcaatgccctgaacagcctcctgtacacccttaaggaacttactttgtaatgattattaagaactcagcgagaccccgagcatcacctcggcatatcgcatcctttctctagagaacccctaatgttggaagggatcagagcgcacctcctccgctcctgggagcacccccttcctaataataccttggggatgggtcgga

SEQ ID NO: 135 - DNA, 50 bp, Homo sapiens
acttgcatgcaattatcatagcccgagtgctcctccgttgagagacttcg

SEQ ID NO: 136 - DNA, 1024 bp, Homo sapiens
ctcaatggcttacaaccagtcactaaagcctccttgagtatcaacttaggcctgggtgaaatgggttcaataacctgtgtccatgcagcagacacagcccattatattgccctgtatgcctctgtactgtaacagcctgtgagcagcgtgaggaccgagggctggtcctgtgcactgttgtatccccagtacttagcatacagcctggtccacagagaggtaaaataaatgttgaatgaatgaatgaaagtacagggctctgaatcctcctccaaagctgacttaccatctgaaaataaacctggtgcatggcacagacattcccctttcaattcagagatgaggaggcgctaaacagttggttccctatcctgagggaaggaaaggcaagcctcggctccagatccggttccatgccatgttttggaatttgtgtttacgtctgccttcatccccatcctttccgctccagcataagcaaaattataaccccgcacaccgacttgcatgcaattatcatagcccgagtgctcctccgttgagagacttcgcccccgagaccgctgactgtgaatgacaaatcaaaagtcagggttgcagaatcagccggactttcctgctcatttgcagcagagggaggaagcagagaatgaaagattctgaaaataaaggtaaggggcggactgcagaaagatggctaagagagggctaaaggctaaaagatgctagggatgcgatgtcactccacagacatatttagtttgtattaatggctagtttaaaattaccatacctatattaacattctagttatataataaacatgatgactttaaaaaatgactagcttctagtttccaaatattgtgtcattcagctttccatttttatagtcctaaatataaccctatttttgcattcttaatcttggctgagtaacacagctttcatagatttccttagactagctcccagatttttgataattttattttgggggtgttcacaatagttaataatgaat

SEQ ID NO: 137 - DNA, 50 bp, Homo sapiens
gtgaggcattaacggtgtcatgtccacccagggagcaggcgggtgcttcg

SEQ ID NO: 138 - DNA, 1024 bp, Homo sapiens
acattttggattcgtgtgattgtttcctcggggtgttttctaggctcgatttccccatctgtgaaatgggcgcagtgacagtagccaccacatgggtaccacattctactccccaggcagtgcgagaactgcagggcatagtgcctgcacagcgcctagtgcagtgtctggcacatcacggatgctgaataaatgagccattgccatcaccatcattccaaccagcatcctccacctcatcaccaccagcatcttcagcaccccagagtccaagccgcgtcaatgcgcaaacttgtctcattctttcctcacccttctggaatgtcttatgcccctcctgctcagttccctctctcctggagaccttaagcgatgaaacttaagccgtatgaatctcttagcccctccagcaactggagtttagcctcacccatcttcctaaggacaacctctcttttttttagaatcacaattttctgaccccaaatggtttagacacagtgaggcattaacggtgtcatgtccacccagggagcaggcgggtgcttcgtcattgctggtgctggtggtgggtgaccttggcgcggaggctgtcggtgcggcagctgctgcagtgctgtcggagggttgctggggaaaggagattggctggcgaggaagatgaggaatgtgctgccaggagactgggatcacggccagatgctaattacgatggcctgggggtgctggtaccccctgtcagcatcatgtaaggaagtgtgggggctggcgggagtgggggaggtgagagaaacgggcaaggtgagagggactgacaggttggagagatccacttgttccccaagggtccaccctcccttcagacccaagctgtctgggagaaattgtggctgtcaccatagcaacagcagcagctgatgcgtgatgcacagtgtctgttagagaagctcggtcaagcttgtaccagtatttttccatccgaatctcatttcttcagtgaaatgagagagatcggaggctgggc

SEQ ID NO: 139 - DNA, 50 bp, Homo sapiens
ggagaacaacgggcaggtgtacagcttgctcaactcgggctcagagtacg

SEQ ID NO: 140 - DNA, 1024 bp, Homo sapiens
caggaggccgaagcctcccgacgctcccagcctgttgcttattcattcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtgg

SEQ ID NO: 141 - DNA, 50 bp, Homo sapiens
taagtaaaggtgttgactcttctagagggcccacccagcaggtgagcgcg

SEQ ID NO: 142 - DNA, 1024 bp, Homo sapiens
agcgcagaagccgaaaggcgccttgctgcggccgcgccctgtggctgaacttaggccaattccgagcgagaccgagacgcagggcggcggtgggggctggaaggggcctttcatccactccagccgcaggacccctgctgcagctcggagcacgcgcagcaatgcaaataacacattcgaggagagcagaggaggtggctagccgcagcttggacagttggaatgtcggagggactaccctgcaaatcacagcccttctatcgggattctcagctgggcatgatggaggcaaatttggaaacctaagagtaccacttgccttcctctctcattgctccatcaccagcctttggtggtggtgaaatattcttttcagttttccaaagcaaggaagtattttctcacaaaatagggttttgctgaattctcagtttccacccaccttccgcctaacatttgtaaagaatcgggcatgcaggatggggactatgggtcaaaaataagtaaaggtgttgactcttctagagggcccacccagcaggtgagcgcgcgggacagagtctccggagagccagcgccgggccctggtggcctcctgctcttcacatctcaaggcagagcctctcaaagagtggcctgcaaggatctgaaccaccagggggtgtgatattgcagagtccctggccttacctcaggctccttaaaccagaatctctgcgggtggggaatcagcaggttatgaggtacaaccacacgaaattgcctacattcgtctttttgtaacctacagaaatgtccatttcgatacctccagctgattcccctgcaccttaaagtttgagcatcgctgctttggcgttttagagcccttggacttgttcacaagaggaagagggagaagaggaggctcgaagggggcctttatagtggatacctgtttcactcggagctcagggtctttgacgcgggaaggcaaagtctgtcttttggaaatggggaagtgggcacacagcacctgagaaca

SEQ ID NO: 143 - DNA, 50 bp, Homo sapiens
tgactaccattgattgaatccttgccaggggccaggctctatgccaagcg

SEQ ID NO: 144 - DNA, 1024 bp, Homo sapiens
cactatggccgtaccccaaccagcctcgcccccgggcccagctggagctgaggccccgccccgctacggagtctctcctctatcccggcagccccgcccccaggttacactggggattaagcccgccccgctccagccctgtccactcacggcgctgcctaacggtcccgcccagctcccgcctacctcgtcctcccggtctcctcccgggccctcccagcgcccccgcctccttcactttctccttcgagcccaccccatcccccggccctagtagggtgaggccacgcccctccccgcaccagcctgggctcagcgccttcctaatcctgccctgccctgcccctctcatctcgggcgggtagccctggggcccccacgctggcattccagggcgggtgtatccgggtgccgccggggaacggcgtgggagcggtttgtgtcctaagtcggggcctctatcaggaggcggcctgggcccaggaactttttgaaaatactgactaccattgattgaatccttgccaggggccaggctctatgccaagcgctgaatacagttctagcccttgaattcccacaactcatgggtactctcgttgcgcctattttactaatgcgcagtttaaggctcagagaagggaagtcgagggctctgaatctcatggaggcgggcgtgagcgggatccagcctcaggtcctgagtcacaggcttgagctgccccagcttgcctggactggcccctggggaagtagcccagaacaaccagtgctggggcagtgcccagcagctgcctgaggtgagggaggaggtgtgggttgatgagaatagtggcaggaggggctgtgggcctaagccctcaaagctggctttctccctgaagaaaaagtggcccaaaattgaggtgggctgcaagagctctctaggtggctgcggtgcccaccctgcgtcccagccctctgccctcccaggctccagaggactagcctcaggcagattacctggttaatgaccaggggcatt

SEQ ID NO: 145 - DNA, 50 bp, Homo sapiens
cgcaggctctatctgctctgaatttagcagtgacagtgagatttagcaaa

SEQ ID NO: 146 - DNA, 1024 bp, Homo sapiens
tctatagcccttagccatagagaggatttaaaggaatcttctgtaatgacaccacggaagccctgcagaagtggaggatttagcataagtaccttgcaatagtttctactcatacagatatctgtgcaaatgcatccatctccccgagctatttttcagattccacagaattgcatattcagcaatttataaataactctcggttccgaaacaatgaaaattttaaagtgaagaacagttctaggcagaagcaaacagtacacaatttaaatagaattccccaatgacttcaaagagtaagaaatatttaccttcaagaaatcacaaaagcagcacttaaataattgggttggaagactgctgatttttcccattgcttctgaagtacaaagtctgaaaatgaattggttagcaggaataatgaagcaaaaagaaatccagagagatgggagatgttgagagcaatgtcacatttcaattttgaggactttattccattgcgcaggctctatctgctctgaatttagcagtgacagtgagatttagcaaacagaagagggatttagagaaaatcctcacatttatctacaaaacacagacactgtagacaggaaacagctgggggaacatttgccttctctctctctccctcttctggcaaagttattgagtaaggacttttttgggcatggtgacaaataacatcatacctttgcattttaaaactagagcacagaagcatttttttcccttaaaagaatgtgtgttagtgacagggttcgcagacattaaaatacttatgctgccatagaaaataaggatctgttttctgattaactttctgctgggcatgaagacacaaacgtctgctaatacaccttaccagtattaaaggaatatgggggatgggagagcaattttagattctagagcaaatgcattatttaaaacaaaaaaagaaagaaaggacgataagaccctctccagcaaactctacaattttaaccctgaagtgactggggta

SEQ ID NO: 147 - DNA, 50 bp, Homo sapiens
cgggttaacagatgcagttattatgcccatttaacacgagggaaactgag

SEQ ID NO: 148 - DNA, 1024 bp, Homo sapiens
aggaataaaaatgaatggctactccatagagcagccgactgtcattttacagatgtggaaactgaggctttgagaagcaaagccggtggtctggtggccacgagggtggggacccagcattagagctctgatgcccccctttcatgagcccatgtcacacccccataggctgggggtcatctgagaccccgggtccctaatgggggattccgcccaaagacgcctccagttctggagaccaggactcaatcccagcagtgccctttcctccggcggccctgcagctggggtgtgcgggggtggaattaggcctcccccagcccagggtagccccttagggtcaagcacaccccccgcctgtttcctgggggcccccaagcccgctgcggtggcgtcctggctctgatagccggtttccttccccctctgaacgtggggccacagtcatgagccctgagcactgcctgcctgcctgcctgcctgcctgccgtgcgttctgcacgggttaacagatgcagttattatgcccatttaacacgagggaaactgaggcccagagaggttgaggttcacaggttgcagcagggccacggtgtgaacgcaggcagcctcggaaacagctcccgcgcgcggccttccctgcgccaccttgtctgggtagctgcctgccccatcactgcctgctcaacgcctccacatgcccctgccacctcttgcacagctccttagccccgggccttggcacacgctcttccccttgcccagacagcctctctcctggtcaggccgctttctcgttctgtctcaagctgagcccacgtgtcctctaggagacacccccattctgccccaggacaggcatgtcctggtcagaagctgttttgtttgtttttgtttttctgagacagagtctcactctgttgctcaggttggagtgcagtggcatgattttggctcagtgcaacctctgcctcccgggttcaagcgattctcctacctcagcctcctgggtagctgtgatgac

SEQ ID NO: 149 - DNA, 50 bp, Homo sapiens
gcaaggaggcggatcaggctaggtcagacattggcatcgtggagccgtcg

SEQ ID NO: 150 - DNA, 1024 bp, Homo sapiens
gccgggtctgagcaggtctggaggtgggcggggagccctggcctccccacctcctcccgtccccaccctgttcccagcactcaagccttgccaccgccgagccgggcttcctgggtgtttcaggcaaggaagtctaggtccctggggggtgacccccaaggaaaaggcagcctccctgcgcacccggttgcccggagccctctccagggccggctgggctgggggttgccctggccagcaggggcccgggggcgatgccacccggtgccgactgaggccaccgcaccatggcccgctcgctgacctggcgctgctgcccctggtgcctgacggaggatgagaaggccgccgcccgggtggaccaggagatcaacaggatcctcttggagcagaagaagcaggaccgcggggagctgaagctgctgcttttgggtgagtccagggtcggtgggcggtgggtggtgggcagtgggcggtggccagccggcaggggtgtcggggcaaggaggcggatcaggctaggtcagacattggcatcgtggagccgtcgcctcctcccagggaatggggagcctggaacccattttccagatgagaaagactgaggttcagagaagccaagttccttgtccaacgtgcgaccagcggccaggtgcccaggcctgtccactgtgtggggcatatacaatagcagacgtggctctaccgggcccctgccgggcaggcccagcacgccctacctgtctgtgtcatggcgagggaatgatgagctcaggtgtgcaacccgttctggccagcccacccgtaagggaggggccggctccagcctctccttcaccaggacgctccctctcgcctttacctccctgccatggctggagagggcttgtctagggctcctttgggggctagaaaggatggattgattggttcattggttcattcattcattattcattcatttaagatttattgggtagctcccaggaacgaggcagccaaacaggggaagatatttctgtct

SEQ ID NO: 151 - DNA, 50 bp, Homo sapiens
gccttggcctgcattttattttcaaccaaggttgaaatggtagccccacg

SEQ ID NO: 152 - DNA, 1024 bp, Homo sapiens
gacctccccgcccccgggccgcgccccgccccgccccctcctctggggcacaccccgccccgccgcccctccccctccctgggcacaccctatgccgccgttcctccccctccctgggcgaaccccaacacctccacctcttccccctccctgggcgcaccccatccacgcccgaccatccccctggaccccgccgcccctccccctcttggctgcgccccgccccgccttccgggcgccctccttccccggtctgccttctccctgaccctcctcccggtcgccaggaccccgcggcccgcgaggcagctctttgttccccggcctcgccccgccccgccccgccccgccccgccgggtcccccgcttcgtccccggccgcccgcttgtctctcccctcgctgttctgcccctttgtcttccacgcctgccccttcaactcctcttgccctgcaaaccccgggtcgccacctccacatcccttccacttctacctgcctgccttggcctgcattttattttcaaccaaggttgaaatggtagccccacgcaaaatccgatggtgtgtggaggaactgcccagtcattgcagtctgcacgccttcttaagtgccaggtgcgagcaaggccgaccaggaactgccgatgggcttcacctgtcagactggactgccacctgccacacattcattgaacttttaataagcactgccgctgtgcttggcgttttgctgggctccagaaataaaaaattcagagaggccaaagttcttcagggatgcagacaggtgatagaaccatcatttattgagcacttgctaagtgctaaatactcttacctgcgttatcttgtgtaatcctcacaaccacactcaacgacggcctattgaatgctctctaggtgtctggcagtgttccaaacagtttatgtgtattactttgtttgatcttcccaaccaccaatgaggtaagtactgttattttaatgcagaggaggattatggagggacagagattaaatgac

SEQ ID NO: 153 - DNA, 50 bp, Homo sapiens
cgtagagtttatttgggtttttagtgacacctcaggattattatacagca

SEQ ID NO: 154 - DNA, 1024 bp, Homo sapiens
ttgctgctgaggctgctggagctgcggtgtagagcaagttgcaggcctctgagcctgttggaggttcagaaaggttagctgacttgcttaagtaagtgtcctagacaggagggagaaagcgcgcgggtctcagatcccagctccaatatccacgccttttcccttttcatctcccggaaggaagccttcacaggtggggaaaatgctcacccagtgactctaaagtagtgcacaaattggcattaatcagaaccattctgattcctgctatcaaggtttatttaattctaagctcaaatgacacagaaaataaaatttcctccttaaaaggttctgcggaaaaatattctctgttctacgtaacagcctccttggctgtgtttgtgtctgaagaaaggactagtctgacaggaagaattacaaatctggagctcattttggcgtcgcagagggaaggtgggtggagcgtctcgcagtaaattaggaattcagaatgaaaacgtagagtttatttgggtttttagtgacacctcaggattattatacagcagtgtcagacacagctcaaagtaatgatgactgctccccctccgccccgcgggagctgggtgctaagaagggggaacccctcctttgaggggttggggtggggatcctccctttccaacctggatcgggaaggggtttgagaggagtgcggcttggatccccatcctggatctgtgctggagggaggcgggaggctatttgggggtgtgtttgggctcaggatctgggtctgacgctgggatctgaggactttctgggtttggaactgggtgggggagctgggtttggggtgaccgctgggagcaggaggaaataggagagtgagtcgcatgtgaagggcactgaggagggatcttcgggggaatgctgaagttgatgcgtggacttggagaggggaagttgaagtggatgcaggggcctggcgctgcagcggatctgggtggcatgtgctgggattgccaatgcggagctgtga

SEQ ID NO: 155 - DNA, 50 bp, Homo sapiens
cggaaaccccaaactcagattttaaggtttggacaagaagtacctgagga

SEQ ID NO: 156 - DNA, 1024 bp, Homo sapiens
caaccattcctccctcccgcccctggcagcggagcgcggggcggtgccacgcccagccccgccccctggttgccgggacaacgcccgcacgcgcccggcccctagtcccagcgcggggagggtactatcgcagcttctccgtcaggccttgggccatggcctcgctacgcaatgccaacccgaggctgaagaactacttcaaggagaactacattcctcaggtctgcgaggtactggacacgcgtggcagcggacacagaccgtcggtggggagttagaagggggaggagtcaggaaagacttcccggaggagggactaggtttcgggattggggaggagtggagggaaggcggggcagaatgcgagaaagtgaagtcaaattcggacttgtaggcgatcagggctgaagacgctgattagagagaaaacagagggtgatggtggctgcacgtggggaatgggtgacatctcccagggggaatgagcacaaggcccagatcggaaaccccaaactcagattttaaggtttggacaagaagtacctgaggagtggaggagtgagaaagaagtgccagagagcctgaggaggaaaatcagcagactggcattatgaagaatgttgtcagaagtagggagtaggcactagtcacctaagataaggagctggattctgcccaaggtgagcctgaggtttccatggagccgtgagggcagaaaatagatggaggttagcggagggaagagtggaagctgagacctttggtcagtgtagtcagccctttgtgaaggtaaggaccctctcaaccaggattgcctttagacaacaggaaggactgccctcctactgccgttataagagtagggaaggaagacaggaaggggatagacattaggttttgtaggtttgggggtaggaagctgagaacatttgcctttgttgacctctttttttctctacaaatagttggtgagatatttaccaagaatgtgcgtgtttgagtggggatggggatgttggtgcag

SEQ ID NO: 157 - DNA, 50 bp, Homo sapiens
cgctgaagatgcgctccacatggggctgctgttcccgaaccttgttctca

SEQ ID NO: 158 - DNA, 1024 bp, Homo sapiens
ttagagataaggaaactgagactcccatcacaaagctggtacatgattgagccatcctggaaccccagcctaatcccaaaggaagcaatgtggcccagcctcccaccccacagtgcattccttggtggggccaacttgttcagccagatatctctattctcccaaagagcacagaatgatttttgccagcctgggccatcacagaagaaattaagctgaaactgaaaacaaatatagagttggaaagtccctcaaaactcaggggcactgaggttgccagtgagacaaccaagaagtggagatcctccccaggcccctcctcttccctgctctcctcggccctgctctcctccgccctgggggaaagcgtccttggtgcctggagggatgggggagagaaggcgttcaccttggctctgctggcgttttccttggggccctccagctgcagccagatgtgggggttgtccggacagtccttcggaaggacgctcacccccacgctgaagatgcgctccacatggggctgctgttcccgaaccttgttctcagcctccgcagacaccgcaaagcgatctggggacgcggggcgggccccccaggtaggcatggctgctgcccccagccctggaaggggagaaggcagctcagagcctcattgtaccctccatccaaatcctggttcctgggactacaccagctatcaacaggtcgcacctagttaaggctctggtaaacagccccaggaggtgacaagcatctgagtccactggaggtagggagggtgtatgtcacgcaggcctctccggagaggaagtcccggtaaacaaggctgtctatcgagagtgggcgtctgggctttggaaaaggatgaccacagtccggagcaagaagggtgggggggctccagctcggcctggaggccagaaggagtctcctggggcactctgaagcttcttaaggacgaatcctcagcaggggattgaactaggctgtcctctgggggccctggtctgccatttcc

SEQ ID NO: 159 - DNA, 50 bp, Homo sapiens
cgctagcaagtgttctggggaaatgagatctttggggaccaggaaagata

SEQ ID NO: 160 - DNA, 1024 bp, Homo sapiens
ttgcatagacaccctggtggggaggggcagggaaagtgagggagagaaagtcccggaaaggaggtgtggggatggagagggggcctgggtcaagtgcggccttggtggcgagtcagttgagtccagcttggaccagaggagaaggatggagagatgtctgggtagagagggggaagcccggagaagactcagatgaggaggctcaaggagaggtgggacacagagaaaggtgtgcaaagggacattcacgcacagaggcggggaggattcctggagccccagatggaggcactgagagtgagggtgaggcagaaggagaccaaaaggcagggagagcgagaactggagacagagacacagagacaggcagagagacagagagcaacaggcagaatgttgagagctgggagatgccagatacagagcgaacagatacgggaactcggggagacaggaggatggacagagtgagagccacggaggacgcccgcaggagggcacgctagcaagtgttctggggaaatgagatctttggggaccaggaaagataggaactggggggatggagagtccgaagtgaagagggaacagaaccagaaggggcaagagacagggtggacccctcccctccactcccacccaccggccgtgaggagcagagaaaccactgcccatgggtgaggccccacagaggggcagtgcaggtggggaccccgggtgcaggtttgggggccctcacttactgtgcagcctccagggcgagcatggtggtgccgggcgggctgtttgccgcccgctgcagccgccaaccctatttatatcttggcccagcccctgccggggggaggagggtgcccgctggccacaagctcggccctcctcaaaaatcccctcagggagggggtcaggggagggggctggattgcacaacccctttgtcacatggcagggatggcgggccaggggctgtctggatttggggatccccgtggggctgggtttggggggctgaccttgagggctg

SEQ ID NO: 161 - DNA, 50 bp, Homo sapiens
cgggactccgctgccccaggttccgggacagtgactacatttcccaacag

SEQ ID NO: 162 - DNA, 1024 bp, Homo sapiens
ggataggggtccagtccctttgccccgctgggatctacagtttgctatactgcctttgtctgggagggcatccagttgctcttgagtgtggtctatccttgttggaagtggggtacgtggattggagaaggggacctagtccctttgctcctaggacatggctcttcctctcttttggggacagtttttgttctgctagcgcctctctgggaggtgtcagtggtgtgtccatgtggggttcagggaacatccccttactgtcattcaggagggtcccattcctctttccttggagacaggaagtgtcccattgctgcttgcccttcacccccgccccagcaggcccattgcatcagctgcaggccgggggttggggggtgtcccagccctcagcttgcccactccctcctgcccagccctgccctggctttcctgctctgctcccacccacagctccctgacattgtcacctacctcctgagctgtcaccacagggcgcacgggactccgctgccccaggttccgggacagtgactacatttcccaacagcccctgcgccacatggtggtcagtcagcctgcaagtcccagcatgcccgagtcaatcgtggggtggggagtctctccatccgtgttaaccccttaggccctggggtacactgggcttcctataccagaaaggttttctaatgattgccctcactcccatccccagccctctaggtcatggggccagagcttcccacccagaaggaagatggtcacattttatcttaggggaagaatataatgcatttttattttctccttagttccatcctcagctcttctcactccagggtagacaacccggacctctactgaaactcttcccctaaaataactaccttctcctggtttaatggagggagaaccagactatgaagaaccattatgtccattttccaggtggagaaactgagccttggataggttaagcagtttgacattaagtcctgcagctagcaggtggcaacactgggac

SEQ ID NO: 163 - DNA, 50 bp, Homo sapiens
gggccggcaagcctcaaggcttaatgcaagactaaatacagctgtcagcg

SEQ ID NO: 164 - DNA, 1024 bp, Homo sapiens
ctttccttaggttcacgggtaccgctatttgtccagcgtccatttgcggtggcattaggatgaggtgctctgtgccctctttctcccagtgtgaatctgacacacgcccccaggagagtccgaggggcatcacttctggaggacgccctgggccctgaaagacagctcatggtccaactgaggagcctgcaccttgctgggacagggtggcccaggagatctggggtctgtacctgctcctggaccctctccagcttgttgttctgggtggggccagctcaggaggggcacctgggctgggagtctctgaagcagctgcccccattgctccaggagagggctcagcccttgtcccagctgcggggccagtgggagcagtgtgcagcgtcctgccctgggctctcgctggctctgcgccctcgcctggccagcccgggagggtgcagaggctcactggcagctcttcctgctcccacacctgcctcttcctctgaactggagggccggcaagcctcaaggcttaatgcaagactaaatacagctgtcagcgccttcctctgagctcgcttgggagctgtctggggggacggaggagtgaagattaggtgaatcaccacgccccaaaatagacatcaggtgcttggtggtttgagccagcgtcttgcctggtgcctctgctgtcctccgtggactgcagcccagccagcctaggctccaaccccaacccggagcacccccaggagagttacctgtaggctggaggttgagtagcaccccaggaagaggtgtgggttggcaccagcagtgttctgatggcaaggcagcccccaggccatgctagggtggtggcatagctgttgtggcagctgacgagcttgctgttctccagggaagctgcttctgtggagaccgcaggaagcacaacagaaaaaaacccacaaaacgagcctcagagcactcagcagcagggttttctttgcccagaactgaactggtcctgcatcgtggcttaaattccacctga

SEQ ID NO: 165 - DNA, 50 bp, Homo sapiens
ctggtctgtgtcctggagtgcagggcctgagcctcggtgctcttggtacg

SEQ ID NO: 166 - DNA, 1024 bp, Homo sapiens
gaattcatccacgtgacagctcagggaatgtgtggaccttatttggattctgatttttttttttaatttaacatttataaggaattggcacttggaatgttttctggatatttaattatattgaggaattattgctaaatatctcttggggtatgataacggtaatattatttcatatgtatatacacatggatataacatgtaaaacatgtatgtctatataaaacaatattactattatacatgtgtatatatgcatatacatttatgtgtgtgtatatttagttatttaaagggttcttggctgggcgcggtggctcatgcctgtaatcccactactttgggaggccgaggcaggtggatcatctgaggttgggagttcgagaccagcctggccaacatggtgaaactccgtctctactaaaaatacaaaaattagctgggtgtggtggcacacacctgtagtcccagctactcaggaggctgaggcaggagaatcgcttgaacccagtggggtgaagattgcagtgatccgagattgcagcactgcactccagcctgggtgacagagtaagactcagtctcaaaaaaaaaaaaaaagagagagagagttctcatcttctagatacacactaaaatgtttatgggtaatgtcatctgacatctgggattttcttcaaaatgacatgagaaggcagagtcgatgtggctgcagcagggacaggggactggctgtgagctgaggtttgttatggtctggattaggggttcatgggatgcattatatgattctgtctagttttgcatatgttctaaattctccataataaaaagtaaaaaacaaaaatggaggtttgtgagacttagggtttggggcagggggcccggcatctggtgggagaaaccactcagacgaggcttggggtgagggcggctgttgggcatgtgaggccccaggggttcacagttactggagcgtgaagctgttccaggcacttcacgtaccaagagcaccgaggctcag

SEQ ID NO: 167 - DNA, 50 bp, Homo sapiens
acctccatgctgactctacaaggtaatttgccctgccgtgtggacaaacg

SEQ ID NO: 168 - DNA, 1024 bp, Homo sapiens
tgaatgtaagagtaaattaacaggagctgccatggactgagcaggcccagggttctggacattgttgtgagccctctgctaccacgtggagaagatcagctttgggatttaaagcaattagccacattcacatcagcttccaggtatttgcagtttattatgtgctaaatactgtaatagatactttttatgcatgaatccatttattctcacaaaaccccttggggaagtgaaacagattatttccatagtgtcttaaaaccccagaactctgcgttgctgcgtctattgacatgaacacctgtcaaacctgcaactcatagctcagtattgtctcagtccaatccaaggaaatgaactccttgagaaagctgacattctggaccatggggtagaagctaccctgtctgcctcccacacccactctcaaggatccaagactatgaagggagaagagagagcccaccgagtgacttcctcttataagccaatatcaagacactagtggaaaggaaccagctgaccagtggctcactgtgtctggctggaccagcaagactctgacgtcatcacagaagccttcttggtcccattggtcctttgactgctgtgtacaggatgccacccaccactccagacaccactcaccactctagatgttgggatccttctcccgttacctccattattcttgttctctactcctctgagttttcatagccaagcaaatttccaccattgaagaggctctgagatccaagtcaactaactactggctagggtactgtaaaacacatgggaaattagcttttaccaaacaccaattctatgcccaccattcatacccattctaccatttaatgctgatagtatcctgtgagctagctattattagcatcatttaaagacaaagcaaaaccagtgaggctgaaagaacggctgccctggtgcacacagatggcacatggcagagcccaagccctctccatgagatctgcagcgtttgtccacacggcagggcaaa

SEQ ID NO: 169 - DNA, 50 bp, Homo sapiens
cggggagcctctcaacataagacagtgaccagtctggtgactcacagccg

SEQ ID NO: 170 - DNA, 1024 bp, Homo sapiens
aacttgccaggacttaggggtttcccaagtcaagggacttttcagtccttggcagactggaatggttgatcaccctagtggtgaggaaaatgaaggtttggaggtggcttggaggagaggttgctgggagagctcttctcctgttctctgttgatcaggagtttccctcatcaacctgctgactttgcgtggtggtttcattacaagttgtgagccccttattgggggtatagggaggagaagtgagggcagcctttaaactagtcataggccccagttgagacaattattgccgggaaagaagctgaaatgcttgactagcactgatgctgtgggggattttccctctttcttcaaaaaaacagaaaagacccagtggaaaaaaaaaaaaaagtgatgagttgtgaggcaggtcgcggccctactgcctcaggagacgatgcgcagctcatttgcttaaatttgcagctgacggctgccacctctctagaggcacctggcggggagcctctcaacataagacagtgaccagtctggtgactcacagccggcacagccatgaactacccgctaacgctggaaatggacctcgagaacctggaggacctggtgagtagacacgggtagcttcctgtcgccgaggccctgtctggaattctaacatcctttgccagagtccgagggagaggggacagtgtgggaatcctctcccactgtggatctgtaaaatctagacaggtcagtcagctcccgccctttaagagtttattttccattctgtggaagaagcagataaggagagctgctgtccttaggagacatcctttagaggaagctggaagacacgggttcaggccctgcatcctcctctgagttgctatgtgactgggaacaggatacttcacctctccattctttctctccttttctcttagggtcggaatatggaactagacaggaaagtactttggaggttttcttaccgtaaggaggctggcattgctaatcagtcaatgaatgcata

SEQ ID NO: 171 - DNA, 50 bp, Homo sapiens
aagctggctgtacctcgatggttaagggcagccaggcgtgctgcttctcg

SEQ ID NO: 172 - DNA, 1024 bp, Homo sapiens
ggtgtcacgttgaagaagagatttctcagagatttaaaaaaagaaatccactgaatcttcaaattatttcttcaaattttgattttaaaaaagtaagtatttaacttgatttttaaagtaaaaacatatttaaaaaattgaaatgccaataaaaatgcagattttgtggtggttaagagcctagaattccaaccccattacctactagcaatcttacctcggacaaatgtacatttttgtgcctcagtttcccatctgtagagacacagtcaacactcaataatttttgattgctactggacatacgtgttctaatatattttttaatttttatgctttcttcagtgtatgtttggagagagtttgaacattttttgactctttttcattgagtaaatccaaatacttgtaaaagacttatctatttctttaacaaaaacttaacatggattaaggacccatcttaaggcatcacacattaaaaaagtcaatattgattcaataccggcgcttatactacgacatcacttgttaaatttgttttctaaataaagcccagaggtagtggaaaatacttcacactctaggccagtgtttgctatgcctggttgaccctaaactgttgagggttctttttaaaaatacagatttctgggacccacctgagatgattccgataatcggccatatggatgagtcacttagagatacccatttttaaggattaggaccccgaagcccagaaaatgcctgctgtagtcaacattatagtcacactccacaggcactgggtccacccctttgaccgacattcctttgcggttttcccacccttcttccctgcctggagaactcctattcatcctccagagcccggctcaaagtggcttcatctgtggggatcctccctgccccatagtgagtgctccttgagtcctcgcccttcctagggcatcccaagctcccaggggctgcccctgctgcctcgccatccgctccaaagctggctgtacctcgatggtta

SEQ ID NO: 173 - DNA, 50 bp, Homo sapiens
gaatctatagatgtgtagctgcttttctctctctttcaagtgatcctccg

SEQ ID NO: 174 - DNA, 1024 bp, Homo sapiens
ggcggcggtagcccccacctgcccagggcgcgcggcccgaccacccccggcggacggggctcagccgccgcgcttggtccccgactcgtttcctgcccccgcgccccgcgttcggccccacgccccagtccctcggaggtccccctgccctcctgcgcgcctgtcctttgggggtccccgtgctctctcgcgcctccgtccctcggggtcccctgccctcctgcgccgggagagccctgtccaggttacagctggccgcgttccgaggcgctttcccggggctctcagaggcgtcctcggggacagtttcctcctcgccccgttcctggtgccctgctcttctgccctgcctggtcacgctgagcgatggcactgggggccacttccccggacttgggcgcctttcctagccacatcctctctcccaagctcctgtcggttgtgtggtcttgggccagtaatttcacctctcgggacctctgttttctcatctgtgaaccgaatctatagatgtgtagctgcttttctctctctttcaagtgatcctccgccttagcctcccaaagtgctgggactacgggcgcgtgcagttacgcccggtaattttttttatttttgtagagatgggatcttgctatgttgtccaggctggtctggagcttctggcctcaagcggtcctcctgccttggcctcccaaagtgctgggagtacgggcatgagccatcgtgcctggcctgtatttctgtctttttcttttttctttttcttttcttttcttttttttttttttttgagacagattctcactgtcactcaggctggagtgcaatggtgcgatctcggctcattgcaacctccgcctcccgggttcaagcgattctcctgcctcagcctcctgagtagctgggattacaggcatccaccatgacactcggctaaattttgtatttttagtagagacggagtttcaccatgttggccaggctggtctcgaactcctgacctcaggtgatccaaccacct

SEQ ID NO: 175 - DNA, 50 bp, Homo sapiens
cgagccatgtcagatgtgacaggcaatctagttggcttgagtggaaatgt

SEQ ID NO: 176 - DNA, 1024 bp, Homo sapiens
tggagtatcatgtcctcaaggtccatccgtgttgtagcacgtgtcaaaaggtccttccttcctcaggctggatatgggctctttaaaagcctattttcttagagcaaaacccgtttcccccacacctgatcgtcacaagccgtctaagacacgtggtctagggtttgctagtgatcgtctgtgggctttccgagcctgcgctggttttgctgccacaacctgaggtccgcggacgtccctgtgctcgctatgacttctttgtgtgagactgtcagagtgtgttcctggccctgacacgtgctcggcggctggtttttctccttcagatcagcggccttggacagctttcgcttctttggcagccgtttcaagctgctccgtcttgtcattttagagttcaatatctgctgctctgaaggaagaaacggggatgggctggaccattgcacttggtctcttgacctcgatgttgcccatgagcagtgaaggatgacttttgacgagccatgtcagatgtgacaggcaatctagttggcttgagtggaaatgtgctgtacaagtttgaagccttggttgggggcatttttctggtgttcaatgcatttaaattgacaccagacttcagtatgttgttcatttcaggcccagcactgtaggctcccatctttaaaatgtgtgggtgccgagcgctccctcgtcagcttttgcaaagcattttgcatattcccagtactgtatttacattcctggctcacattggtttttgttttttgtttttcctatcttaaagcttatttttgaagtgaatttttaatgctttcagttgagtagggatttgtggaattttgaggggtggggaggtgcagtggagaaaagggggaaaatggttgtttcttggctctcagcataagctacattttccatcatatggagtgagatgcctatattgggcagctgtgattttaagtgaaagtcatttccagttgtttctaatgtctagaaattaggtttgttttgattttaa

SEQ ID NO: 177 - DNA, 50 bp, Homo sapiens
ctaatagccacagcatatcccttgcataatatgacctctagattactgcg

SEQ ID NO: 178 - DNA, 1024 bp, Homo sapiens
ttgaattttctctctgcttcttctttattttctggatttttatcagggtgccatttaagtgccactttatgataagcttttttaatgtcctcaggtgaagcatatctttgcagtcctagaacttcatagtaatccaccatgttttaacagatagttggaagtgggtgtgctgggtattgagaaccgtggtttcctcagctcaggctctgctggtggtggtgatagaggtagtgactgcaaataggtacacttttatgttaaagacaatgttattaccatgtgctaagagatgaggatactgattatgtggcaagcagagttacaaatatgtcagagagggctgcattatggtgtcattctggggtcagtgtagggactggaccttccaaatagagctagtccagagtcgtaccagaccatcctgaatcctctggactgtttcccctgtatgtttccctggaagcttcaggcagtgcctcataagccaatggaatctgttgctaatagccacagcatatcccttgcataatatgacctctagattactgcgccttaattgcttcccagctcttctatgctttggtttagaaaaatgaagtactgacttacgggtgaagaaagtattcaaacagttgacatatttatttcagtcaagaaacagttcagagggagatacaaacaagtaacttagttacaatataatagttatgatgagaggaagtactggatgctaaacaattatatgagagacagctcaggctgggggtgtcaatgaaagcctcttggaggaagtagcctgatatgttaactttctgcatgccagtggtaagtcatttgagattatagtatctttgtccacccaaggtttactgctgtaaaacatgtaattaaagatttggaaagttgtgtgtttatgtattcactgtataattattgattgtctactttgtgccaggcaccgttttagccactggtgatagcagtattgaacaaaagacaccagttttcctggtgcttgcattat

SEQ ID NO: 179 - DNA, 50 bp, Homo sapiens
ggaaatctggcaccttcagccatgacctctgatgtctgcagggtcttacg

SEQ ID NO: 180 - DNA, 1024 bp, Homo sapiens
ctaccctctagcccgcccacccagctccagccgtctgtttctgtctcagatgagagggggcctctcaggacaaagaggaagtagctggaaggggaaggagccagctgcagagaggaggaggtgagctgcagagaagaggaggttggtgtggagcacaggcagcaccgagcctgccccgtgagctgagggcctgcagtctgcggctggaatcaggatagacaccaaggcaggacccccagaggtatgtgccaatgaggccagggcagctgagaaaagccaggcatggggaaagggctgctgtctgcctccctatggcctcagcctcccagcaaccccaggtccagagagtcacacagcctccagctagtcctgtagatgactcgctccgtccccagtccgtgcagctgggataagctgggccctggctctccagccaggtgacagctgggccctctacctcagcctgggactggcagccatgcctaatgccctgcagggcaggaaatctggcaccttcagccatgacctctgatgtctgcagggtcttacgctatctaccatgggaccagggggctacagccctactctgcaggggtctctcagcttgagccaacctggctggcggtcctcccaggttccattgcaggaggaggtggtgaggcgctctggggtctgtagtcctgggaggggacttggacaggctccaagtctgagatggggcctgcaagaggcagcgcctctgtgctctgagctgcccgtctgcctggagcatttaagggagcaaaggtcctctctggtgagggcagggagtgtggggagcagctgtccaagaacagccctggcacctcgttgcccagccacagcccaggattccatgtttcctctcattgaccagccacagcccaggattccatgtttcctcttctgagagttagtgggggagagcaaaggcccgatgctgggccctgaatccctggggacagtggggacacggtgggcaccctgaggtctcctctgtggggtg

SEQ ID NO: 181 - DNA, 50 bp, Homo sapiens
cgctgtgctgcagtgcctcaaggggacctcagatggccccactcagcagc

SEQ ID NO: 182 - DNA, 1024 bp, Homo sapiens
ttaactgagggcttatgatgtgctggacactgggctaatagtgctgaacatattgtcatttttaatcttcacaaacaatatttgtataggactgttttcttttcttttttttttttgaaacagagtctcactctggtgcccaggctggagtgcagtggtgtgatctcggctcactgcaacctccgcctcctggtttccagtgattctcctgcctcagcctcctaagtagctgggattacaggtgtgcgccaccatgcccggctaatttttttttttttttttgagaaggagtctatgtgcccagcattgttctagagcacttgcaattagtggtgaacaacacggtctctactccaaggggctcacattcttgtgcagaaaacagaaatgaacaaataaacacacaagatcatttcccgtggtagtgagagctgggatgaaaataaaacagcgtggcagggaggaggcaagtgttgtgagtctggagggttcctggagaatggggcctgaggcgtgaccaccgccttcctctctggggggactgcctgccgcccccgcagacacccatggttgagtgccctccaggcccctgcctgccccagcatcccctgcgcgaagctgggtgccccggagagtctgaccaccatgccacctcctcgcctcctcttcttcctcctcttcctcacccccatggaagtcaggcccgaggaacctctagtggtgaaggtggaaggtatgtccaaagggcagaaagggaagggattgaggctggaaacttgagttgtggctgggtgtccttggctgagtaacttaccctctctgagcctccattttcttatttgtaaaattcaggaaagggttggaaggactctgccggctcctccactcccagcttttggagtcctctgctctataacctggtgtgaggagtcggggggcttggaggtcccccccacccatgcccacacctctctccctctctctccacagagggagataacgctgtgctgcagtgcctcaaggg

SEQ ID NO: 183 - DNA, 50 bp, Homo sapiens
cggtggaaatatagaaaaaggaatttattcaagaggtattcaaaaagaag

SEQ ID NO: 184 - DNA, 1024 bp, Homo sapiens
acaaaaaaaccacacacacacacacaaaccagcttcttgtctttaagtgtgcaagaatgttagcacttaaaatttttaagatacacaaaaactaaacagaactgttcaagtttttaaagggagcttggaaatttgaagaaagtaaagttaaaaatattgccccatgagtcatataattatttttctttttatttctcatagcttccctcctatccattatttaggcaattttgtatccaaatttaataatttaacaccttatttgttacaagaacacgttactatgttattttaagcttttttgggcaaattacacataattagataggctgggttagggctgtctacaagatcccagcctagagtgtggtgcagtagcctattttctctaggactcttgctgcaacaggatatgggagaagggaaacattaacgttagcagaatgggaggaatcagattatggagacatgatccttgccttctggcacctctccagctgatttagaagaggacacagagggagacagacatatggccatttctataattataaactctgctacatgctgagaggatggcttctcaaagccagttagtgtacaagcagtggaggttgggactgccctacttctcctgcctagggtcacacagtctggcagatctggaaagacttccctgagaaagtgaccttggaactgataccttagtggaaataactaggcattgggagggggtgaggtgaggagaaggtcaagagctttcatgtagagggaactttgtgcagagaccttagtcaggaagaggttttgcatagtggaggaactgaaagctaacagccaggctacagtacagagcaaatgatgctggggtgtgaggtgatgtcaaaaggtagacaccagggctagagggcgcataatcttgcaggccgtgctaatgattttgttttctacccaagaatgctacttcaggagatcagtcaaaaggttagggtgatggtgacggtggaaatatagaaaaaggaat

SEQ ID NO: 185 - DNA, 50 bp, Homo sapiens
ccgtgagtacatgcagctgaactgctgtcagtcttatctgtccagtgtcg

SEQ ID NO: 186 - DNA, 1024 bp, Homo sapiens
tgagtaatcttaaatagagaaaatccattatagcctatgctactcaaatggagatgtttggttgaaggatggttacaactactggtgaaatagacactgagaaagaaagaacctaggtattccagaatcttcccagagttcaactgagatttaattgtagagtagtgagaaaaaagttttgagctgggcacggtggctcatgcctataatcccagcactttgggaagctgaggtgggcggatcacgaggtcaagagatcgagaccatcctggccaacatggtgaaaccccgtttctactaaaaatacaaaaattagccaggtgtggtggtgcatgcctgtagtcccagctactcaggaggctgaggcaggaaaattgcttgaacccgggaggcggagcttacagtgagccgagatcgtgccactgcactccaccctgggtgacagagcaagactcagtctcaaaaaaaaaaaagttttgagttagcagccatcctttgagatattttaggacccagaccaatgagatcctttctaagctgtatacttgctgaaacaacttaaagtcctgtttggtctcttgtctacctcccatttacagttccctgaacctccctctgcccctgcctcaggggttctccctgttgctttcctctgtcttggattaaaatgtagagtatgagggtattcctttgagtatacaatgctgagaagaaaggagcaaaggcaaaaatgagaaaaataatttaaaatagaacaaattataaaagcagaaagaatgacaaattattttctcagaagaaaagcagaattgcatgtaggcccagctcaggtgacatcccagcagaatgctttgagtatgaccagagtattgcaaaagctacagctgaagaggataaatctagataagaattggtagatggtttgctcactacttcttcccccggttggtgagggagggagtcccaacccagggttatgggtggctggacacacaacacccgacactggacagataagactgac

SEQ ID NO: 187 - DNA, 50 bp, Homo sapiens
agcccaggttcattcctgactggcttgaaggtcctcagcactgccttgcg

SEQ ID NO: 188 - DNA, 1024 bp, Homo sapiens
ccctggaacagaggaggcaggcacagagaggtgagtctgggttcactacccaccccacaatgttaaaatataagagaaaagtcatcccatgtgtccccaataatcactttggcattccacaggcagtcacctgagcagagggtgagaagctggaggaggagaggggtccaggccatggtggagatgccccaggctctgcttcctaagcccacagctgagcagaactgcacagagtctctcttatcctctcctcctaagagggcacagagcacccttcatgcaaatcacacccctccccctgctatccctgggcctgaacttggggaaagttgagtgtggggtggggctagaggagcctcttctgctcctgggaggtcccagctgctgggccccagaaagcacagagcagagggcccagggtaggggtccagggcctggtttcccagttgaaacccccacagaccctcagggacaggccacacttccctccactgtctcagagcccaggttcattcctgactggcttgaaggtcctcagcactgccttgcgcacaccatccccacacagaggcagcgctcacgcacctccacccccaccccaggctctttgtgctgcaggtgctcaccacagcacatttctcgctgcaagatgggcctcctcagcatgaagtcatcctctgcttcttccccatttagatttttgtgtggttggggccataggtgagtgagcctcagagagaacatgtcctgcacccagtggccaggagggcaggagggttaacaaccctccccagcctccatatgggcctgagggcacctgcttctctctctcatcataccccacatccccccgtgggaggccgggctccgtgaccctcatcactgtcctcatcacacccttgatggggtgagacccttaatgaaaatgcacagggaaattattcaagaagagaccatcattatgaaagagagaaaagtctgcttctcttatggatacttggacctgaggaagatgaccaaggtc

SEQ ID NO: 189 - DNA, 50 bp, Homo sapiens
gtgaacaatcttgtcaccaacacgattctggaactccagtagcattgtcg

SEQ ID NO: 190 - DNA, 1024 bp, Homo sapiens
aaatgtaatttaaatacaagtagagtctaatacttcttaggcttccttttgctatagtaattatacatgaggcttaattattcacaagagcaggaactttactaggaggactcattccacaaacacttgattcttccaacaatttcttttaaatttgctatttcagtctgtggtgtgtccacaaattatttacatctctatatgctctactcatatattttcattgaagtttacttaaaagaatagatgtccatatcaaaacctttattagctttcttgttccaattaagtatacaaaatcacaaattgaacatgtatatcctaaatatacttaatccatcaaatagaacacttgcaacactttaatgaatacaacaggaaaatataaaatactgatttcaaatagttccaaagatccttgatttcaggattttcacctattcaggcttaataatctgaactaattccaaattagtgagttttcaccacaccatatgctggtgaacaatcttgtcaccaacacgattctggaactccagtagcattgtcgcagccgccacttactcagatgttatagagagacttcaaaatgtcatgcaagtatttatttatttatttacttatttaaactttaacggaaggcaacacaaaggaatttatcttataaacacatgtggtgcttgctgttatgtgcccaatctgtgttctaagcattttaaaaatattaaccaatttaatcatcatacaatgctatgaagtgggtactattattctaccaattttacagaaggtgaaacaaatagagagtgaggcaatgaatgtccctcccaatccttaatattgtatgattaggagcactaggtgggttaactaatactctggggcaaacaaagccttgtgtctctcaaagccattaattattacaaatgtttttctgcccctaacctaatcaaaagcaactgttctagaaactgaagaatgaattaaagtaacagtgctttcctctccatatcataccaactta

SEQ ID NO: 191 - DNA, 50 bp, Homo sapiens
cggcctggagttgggatcctgccacccggcacttaccagcagacacccca

SEQ ID NO: 192 - DNA, 1024 bp, Homo sapiens
ggcgctttgatctccacttcccatggccaacccccaacacaccagatacgtactcacttagtggagtttggagcctgtgtctgtcctcctagtgtgttggggtcgaccagagcgattggcagggaccgtcagagacagaggtttaagcaggaagagagacactttcttctgaaagtagagccactgacagcttctattttcatagacctaaatatgggcttgccacccggataacattacacgcatggcctctcctggtgctccccacacccgggtgaagtccgtgttattattatctccatttctcaggtaagagaattgggtgagaactagagatgttaagcagcaagttcccacagggctgaaggaggtgagtggtagcgtcaagatgtgaaccactgttactgcacactgaatcataccactatggccgatcacagagggccctggggagccacggaaggctctaggcagaggcagggcctcttgggttagaaggacggcctggagttgggatcctgccacccggcacttaccagcagacaccccaccatgagattatgtctcttgatgattgagcaaataggctcccaggtcaaatgtcccaggtttgagtcccagcaagaaaaaagggaagaggagagagaggcagaggaaggggaaaaaaaagacagaaggaaggagagggagaaggaggagtaggagggaaggagggaagcggggggaaagaaagatacgtgagataatattcaggtcaaatatggacagttttggctgggcacggtggctcacgcctgtaatcccagcactttgggaggctgaggtgggaggatcacttaagcctgggagttcaagaccagcctggacaacatagcaagccgttgtctctacaaaaactataaaaactagcagggcatggtggtgcatgcctgtgatcccagctactggggaggcagaggtgagtggatcacttgagcccaggagttcaagatcagcctgggcaacacagtgagatgaaagaaag

SEQ ID NO: 193 - DNA, 50 bp, Homo sapiens
cggtctctactccaaggggctcacattcttgtgcagaaaacagaaatgaa

SEQ ID NO: 194 - DNA, 1024 bp, Homo sapiens
cactgcagccttgaactcctgggctcaagcgatccttctacctcagcctcccaaggacctgggaccataggcgtgtaccactgtgcctggcttttgcctggttttaaactgaggcagtatgacttgagctcttaggcattaattgaagctgtatctcattaactgagggcttatgatgtgctggacactgggctaatagtgctgaacatattgtcatttttaatcttcacaaacaatatttgtataggactgttttcttttcttttttttttttgaaacagagtctcactctggtgcccaggctggagtgcagtggtgtgatctcggctcactgcaacctccgcctcctggtttccagtgattctcctgcctcagcctcctaagtagctgggattacaggtgtgcgccaccatgcccggctaatttttttttttttttttgagaaggagtctatgtgcccagcattgttctagagcacttgcaattagtggtgaacaacacggtctctactccaaggggctcacattcttgtgcagaaaacagaaatgaacaaataaacacacaagatcatttcccgtggtagtgagagctgggatgaaaataaaacagcgtggcagggaggaggcaagtgttgtgagtctggagggttcctggagaatggggcctgaggcgtgaccaccgccttcctctctggggggactgcctgccgcccccgcagacacccatggttgagtgccctccaggcccctgcctgccccagcatcccctgcgcgaagctgggtgccccggagagtctgaccaccatgccacctcctcgcctcctcttcttcctcctcttcctcacccccatggaagtcaggcccgaggaacctctagtggtgaaggtggaaggtatgtccaaagggcagaaagggaagggattgaggctggaaacttgagttgtggctgggtgtccttggctgagtaacttaccctctctgagcctccattttcttatttgtaaaattcaggaaagggttggaag

SEQ ID NO: 195 - DNA, 50 bp, Homo sapiens
taggccagggtgtaggctacctgccttgagctgtaccaggccaaatgtcg

SEQ ID NO: 196 - DNA, 1024 bp, Homo sapiens
gaggtgggtctggggtatggcaggggctgggcagcagcagcaatgtaccttgcttgggacccctaaaaaccagagagacagcatggctggtgccatttatcagctagtggaggaggctgacggagggtgggagtgtcatcagcacaaggccctggcagtcccttctggtgattagagaggccgaaagggtcctttccgacaagggctgagggtgggcggaacaggaagagaaaaatgtgacatgaggtgaccatccgaacaggtagcaaatgttagaaaggggtacctctggcaaacttagtggaaaagtaatattgcagggagcagtcagataaaaacaagcccttctgtcaaatagtgcttgaagactcaatagggatacatgggtcaatgaagcctttagaaaaagaaatactaagaggcagattctctgagaacatggtaaaagctcacgctccacgttatgaagttgacctttgtgagctagggaaaggcctggctaggccagggtgtaggctacctgccttgagctgtaccaggccaaatgtcgccagggtcagagctggcttattaaaggactgtgtggaagctgtgccaacctcgtggtaacaatgggtaaaagactgggccaggagaaagcagcctctgcctcagcccagacagtgcggccaacccttgaggttgtggcaaaggtttctcctcttaccattgccctccatgtgcatggcttgcttttctcttgtcttcattatttctcctttcctttcctcctctccaacctcctcctcttcccactcatcctcttttctctacctatatcccctcttcattataccctcctctgttctgttgattaccagaccctgacatacagttagcacttaacaaataattgccgaattgcattgactttttcttgctcctttcttcccccgctcttttcccttttcctttccctttccatttcctcctccctgcctgcctagcaccttccccataaggtggttgtgagcagtaaatgtgc

SEQ ID NO: 197 - DNA, 50 bp, Homo sapiens
cggaggctttaaacgcacttcgttgacattcaggaccctcgggaatattc

SEQ ID NO: 198 - DNA, 1024 bp, Homo sapiens
cccactggctgagaacaccatggtggggagagtgacttcatttttaactctcctccctcctcctgtatactcaaggacggagtctcttcttggtgccatggtgtttttagctcctgcctagtgcttctccatgcctctttctaacaaacagctgtaggcctgggaagcagagcctctaccaagtgtgaatctctagctagaattttggcctatggttttaacatttgcagtacattttcttctagagcacattctacttaggggagggacaccattttccatttatgttagtgacataaagcttcctttaaaagataaatatattttgggatggagaattgcttgaacccaggaggcagaggtggcagtgagccgagaccgtgccattgcactccagcctgggtgacagagcgagactccgtcttaaaaaataaataaaacagggtaaaaacacagaagttacagaagcctggcaggaaaagccaaagacagaaggctgacggaggctttaaacgcacttcgttgacattcaggaccctcgggaatattcctcggccctacgggggtgggggtgtgcttgttcttattttggtctcacatccttctcaggccagccttcctcctcctgcatggccaagcagggtgagtccttccttgggaggccgcctgttctctccccgcctcctggttctggatttgggtagggcaggatttgggtgttcaccctcctaggaggccctgagaggctgccaggccccagctctgcttcctccacccactgatgctgggctcagagaagggtggggaaggtgctgttcccccactgatgtcacacctgctcgggggcctggttgctgctgggggtcccctggtatgtgctcagtggggactctgaccggagcctggaccatggagaggagcctcagcctgtctggcccttccctccctccccatggagccttggcatgttccacctcctctgccctgcacacattcaccagtgagccccacgcaggtgggtaag

SEQ ID NO: 199 - DNA, 50 bp, Homo sapiens
cgaccaagagtaggaaccagatacagccagaggaaacagacacccaagca

SEQ ID NO: 200 - DNA, 1024 bp, Homo sapiens
gagaaaccagatcatagaaatcaacaacaataatgtactacttactattcacctacttttgatgttgcatttgctactcaggtttatggtaaggggttgtcttggtcaattttctgctgctgtaaccaaataccatagactggtagatttataaagaaagagatttgtttggcttgtagttctgaaggctgggaagtccaagacagagggcattattgttgtgtcaaaatatgatggagggcatcatactggggtaggggtgggggaggcatgtgaacccaattgactcccgaaataactaaccctcctgtgataatggaattaactcattcatgacctaatcatttcctaaaggtcccacctcttcatactattacaatgacaagtttcaacttgaatttttgaaggggacattccaatcattgcagaggtagtaagggtaaaggtgaactaatatactgcaaagtcttttgacataagtcctgccctggaggaatttacgaccaagagtaggaaccagatacagccagaggaaacagacacccaagcaaaacagtctagcttcaagggttgggtatgcaggtagtagccacactacagtgaggaggagagtaagagtgggccagcaaagcattgaagcttgactttcctctccccacaagggatttttgccttacagctggggaagaaaaaaaaaatcacaaaaataaatagcctgttaagattttagacatcagacatctggggaaaataaaatctgaagcaggttctctaaaattaaagtatgtaggtagtggcctactctaaaggccaataaggactgtccagagaatatttcccttggaattctataagagagtcactcccactacacgctgtcaaggaaaatttgtaatcacttaagtataaaacaggccctcccacaaaaactgccttttctgtctaggacattgcccaatctattgtttacttttggatctcaagtgctgaattccaagaaattcatgggtttagactgaaagcc

SEQ ID NO: 201 - DNA, 50 bp, Homo sapiens
cggcaggattttagcagtcaagattcggtttccagaaagaaagtactttc

SEQ ID NO: 202 - DNA, 1024 bp, Homo sapiens
aatcccgttctctggagaatgagaaccttcaaaggctttcattattaagtagaacccaggttccacttattactttgccacgtactgatgggccacctgacttagactctcattcgtatatgatcaactctaacacatacgagtcttctggctcccccatgctcaatttgtgtgaaaagtcagcagttctttcgtttagcattgagcctgaggaccaaaatgaaacctttttctctgaagaatctagggaagtgaatccaggggatgtttcacttaataatatatctactcagagcaagtggctgaaatatcaaaacacatcccaatgcaacgtggctactccaaacagagttgataagagaataactgatggcttctttgctgaggctgtttctgggatgcattttagagacacaagtgaaagacagagtgatgctgtcaatgaaagctctttagactctgtgcatttgcaaatgataaaaggcatgctctatcaacagcggcaggattttagcagtcaagattcggtttccagaaagaaagtactttctctgaatttaaagcagacttctaagacagaggaaattaaaaatgtattaggagggtctacctgctacaactacagtgtaaaggatttacaggtgaggaaatgtaccggtcttgtggtgcatttttccaatagttattgtctgaatttcaacaaaagaattaccaaaatatactgcataggagcaatttggacagatggctttttttgatcctaactctgagctacagttacatcatcctttacttaaaatctctcgtaatagtagtgaacattgaatgaaatgatttatttgaaagtatctggtgcagtgtctggtaaattatcagtacttaataagtgatagctcctacttttgtttccatcactactaccattacaattattgtttttacttttgactgtcaattgtgtttgctgattaagtcattagggtaaaggtgcatcttatttcacgttaattgtgaataatcctta

SEQ ID NO: 203 - DNA, 50 bp, Homo sapiens
cgggttgtattttacctcagatttctcaggagaccagaactgatctgcca

SEQ ID NO: 204 - DNA, 1024 bp, Homo sapiens
tactttctatttatgtacacatctaattgtgaaccagtttttttgttttttgttttttgttttaaaaaaacagttcagtgcagttcactgactgacactagggcacactgagaaacacttgttttgggaatggtcagagatgaactggaaagaggttggcactaaattgtgaagaatcttgtataccattataaggatttcaaactttacgccatcaaaatttagaccaatctgaaagtcttgctctttattattttcctggatttgcattgtagattaatttgtttaaaacttttgtgccgaatagatgtttgataaaatgtgtatttaaaaagctattttagcttagcagttattggatggtgtcacacacgttgctctatactttttaaaattttgcagttaaataatcttgtttttgaaaacttggctttaaaggaacacttgacatcccagttttcccttccctcttctctaccttgtgtctgttttcataagagcgggttgtattttacctcagatttctcaggagaccagaactgatctgccagccttgctgccttttgttgctctgctctttacattgtctttacagtcaccaggtgtcaagatgctgcaagtacataggactggactgggcaggctgggggtcagcctctccaagggtcttcaccacaaagctgtgttggccgtccggagggaggatgtgaacgcctgggagagaagggccccgctagctcccaagcacatcaaaggcatcaccaatctgggatacaaggtcttgatacagccttcgaatcggcgggccattcatgataaggtgagtatttccaatatttttatgtgagaataaaatgaacctgcatatgaaaattaaggagcatctgagtgaaaataaaatgtttgctagtgtcactttgatttctttactttgattaaaagtattattttcaccctatgcttactccagctgaggaataaaagaacttacttttaggagatgttatttttcaatcattctctc

SEQ ID NO: 205 - DNA, 50 bp, Homo sapiens
ttgacctggggcaaatcacttccctgtgtgggccttggttttctcattcg

SEQ ID NO: 206 - DNA, 1024 bp, Homo sapiens
tgcctcagcttccttctgatggggaccttcctgtcaggtgaatctttcctgggcctcagtcacctgggtgtggggtggggaacagtactggccccagaaggcccctgcaaggaggcaaatcgatggggacagtagggcaggtcctgggaggggtattttttttttttttgagacggagttttgctcttgttgcccaggctggagtgcaacggtgcaatctcggctcactgcacctctgcctcccaggttcaagcgattcttctgcctcagcgtcctgagtagctgggattacaggcatgcgccaccacgcctggctaattttgtatttttagtagagacaaggtttcttcatgttggtcaggctggtctcaaactcctgacctcaggtgatccgcccacctcagcttcccaaagtgctaggattacaggcttgagccactgcacctggctgggaggcgtattcaggtagaggggtgacctggcttcagacagctctgcccttgacctggggcaaatcacttccctgtgtgggccttggttttctcattcgtgaatgaccagatcactagagccctggactctgactttgggtctccttcttagtttttcacaggggaagctattgtgggttggtccctaccccacagggcctgaggcaatctaacctccctgagagggtccctgcagccagttgcctgaggctgagttgatgtgtgggacagcccaggaggttcctgggggtggttagtctgtattcagggtttggaagagctgaagtgaagtgggcggggaagtgggggagaggggtgcagttctgcagagaaacgtgggtgggtagcagagggacctagaggctgctagtccaaccttctgagctctgggcctttaactgaacacagatccttgaggatatggcactaatggagatttgggggctaactccaaacccctcactcacaaagggagatggaggtccagatagggcaccctaagtcacacagaaccaggcctcctgcaccccgtt

SEQ ID NO: 207 - DNA, 50 bp, Homo sapiens
gcccagtcaggaacctgaaccagatggtctcttgagagttgaccagttcg

SEQ ID NO: 208 - DNA, 1024 bp, Homo sapiens
tgttgttatttccccatgtagaggtctcattgccccaacatcgctgtaaactcctcagagagacagcatcctaccccaccacccacacaccccaccgtggggctccttaagcactctcagattatctgccacctcttcttatccccaacacccagggatggctcggtcccagtctgccccagcccatgagatgccctagaagcctccctccctgcaggaacttgcacaaggagagcctggccctgtgcttctctgccctcagcccttggagaagctaggccttagcagggaggggcaggtctgagaggcgcccccacagcctcaccaccactgccctcaccctgcctcctgccctgaactcgaggaagctgcacccagaagaaaaacttgtgggatcctctctgcctgtcgccagctgtgcaaccttggtgagccatttgtctctctgggtctcaggggcggggcctgatctgtaagttggggttcatctcacctcgctggcccagtcaggaacctgaaccagatggtctcttgagagttgaccagttcgggtgtttaccaatctgagactggcctcccctgaggttaccctcccgacccctgggggttttgagcagggaggttctgtatagggatactctgttctattggaggggaagcccttcctggaattgctcacctccccccacttccactgtccccttccaccgcccttctgggatgatgcctccagcctgggaaaacccgaaggcagccaggaaggcaagagttttttccatgctagcccagtgactcactcctgattcccccacgggacaagagtcctgcagcacagggcggccagggccaagactctccctgaagatttgcccactgctgggccccctgctgggagcaaatggctggcatggttgtggctggcaggaaagtaggggaaggggagtggggagtgccaagcactgccaggatttaattcattgtaaacaccccaggattagagcaaggtgtccaggttcccaggaga

SEQ ID NO: 209 - DNA, 50 bp, Homo sapiens
cagggcccctgaggagcagcctctagttcagctctcagagatagggtccg

SEQ ID NO: 210 - DNA, 1024 bp, Homo sapiens
aggtttcatgctcacccccttcatcctttccagatcatgataacatttatagacttgttttaaataccacttactcagtggaacaaacttctccttcccatatgaaccagtttcataaaacccacccaacttgctttctctttctgacaatgataacttaaaatgcattattattgataatgatataaaatatgaattttgaaaaatcaaaagtatttctgaaataacttatatccaaatggcagggcagccccagtacactcctccacatggcatctcaagtagactggcaggcaaagatccaatagaaaaggtcaccaaatcccttgggacatgcttgagctaccctaggaaatgttttgttagccccaactcccactgggtgaaataagagcaggtgtcccctttgagcatcaactcaaacttttctgagctgatttgcatgttgggccattagacaacggtccaagcttctcagagcatccttaaagacagcttgtcagggcccctgaggagcagcctctagttcagctctcagagatagggtccggggctcctttgctgtggatcctcctgctctgggctccaagtgagggggtatagggaaacatcgggcaaactcatgtggccatcattgttttttgtgtctctggattcttggttgttggatttagggcactcattgtaggttgtaagttccccagttatcttttgttttctggttactcaagatgttgcatatgactgtggttacaagtgtcaccaatgcatggcctacatggggacagtctcagtatatctgatataatttatctgtctttatcatttcaggctgcaatggggacattgtgctgacccagtctccagcctccttggccgtgtctccaggacagagggccaccatcacctgcagagccagtgagagtgtcagtttcttgggaataaacttaattcactggtatcagcagaaaccaggacaacctcctaaactcctgatttaccaagcatccaataaagacactgg

SEQ ID NO: 211 - DNA, 50 bp, Homo sapiens
cgcagccaggtcatggtcggctactcatgtcccatgggacctgcccactt

SEQ ID NO: 212 - DNA, 1024 bp, Homo sapiens
aagtccaaaatgggtctccctgggctaaaatgaagctgctatcagagccgtgtcctcctggaggctccaaggagaatctgttccctcgcctgttcaagcctctgcaggctcccgcattcctgcctctccattccctccaacctcaaagccaccagtcccgttatctgccccctgcttgcatgcactcacctccttctctcactctgaccctcctgccttcctctttcacttactcagccccttgtgattacatcaggcccacctgggtaatctccccaacccaagatccttgacttaatcacatctgcaaagtcccttttgccacataagcttccccaactcacagggtctgggcctcaggaggtggacatctctgggaggtcactattctgcctcccacaggccttcagggactcctttaaccaaatctcacatagagcacttctctgcgatgacggagagtggctgggcacgccagtcgaatgcttggtgggccagtacgcagccaggtcatggtcggctactcatgtcccatgggacctgcccacttgaggccaaacattccatctccaccagagcccggtagacatctaaaaactgtgtcgcaaaacaaaactcattctctgcagcgctagcacgatgtagctccaaaatatatatatatattttttcttttctgagatgcagtctcactctgtcgcccaggctagagtgctgtggtgtgatctcagctcactgcaacctccgcctcctgggttcaggagactctcctgctttagcctcctgtgtagctgggattacaggcacccgccaccactcacagctaatttttgtatttttaatagagatggggtttcaccatgttggccaggccggtctcgaactcctgacctctggtgatccgcccatctcagcctctcaaagttgctggggttacaggcatgagccaccacgcccagccaagcatagattttaaatgttttcacagatgttagtatgcggagtgatggacatgttaactgtc

SEQ ID NO: 213 - DNA, 50 bp, Homo sapiens
agacctaccgctgaaaaccaaagtcttagatatgtctcagaactacatcg

SEQ ID NO: 214 - DNA, 1024 bp, Homo sapiens
gagaaagttctaaggtgtacaaaacaaaggcaagcccctgagtgtgaatccctcaggcagcaaccagacaggtcaaaacacacaaccacaattctttgataacaaggcctatattgccccttctggcatgagcaagctatataactggttataaaaagtattacattaaattatggggacagaaatgactctactagtgaatgaagaaatcatttagattttatggttagtaagtggaggtttgagagtaaccatccgatctttattaatcttagtgtatattatatttctagaatttggactcatatcaagatgctctgaagaagaacaaccctttaggatagccactgcaacatcatgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttgatttaagtgttttcaagttcaaccaggatttagaatatttggatttatctcataatcagttgcaaaagatatcctgccatcctattgtgagtttcaggcatttagatctctcattcaatgatttcaaggccctgcccatctgtaaggaatttggcaacttatcacaactgaatttcttgggattgagtgctatgaagctgcaaaaattagatttgctgccaattgctcacttgcatctaagttatatccttctggatttaagaaattattatataaaagaaaatgagacagaaagtctacaaattctgaatgcaaaaacccttcaccttgtttttcacccaactagtttattcgctatccaagtgaacatatcagttaatactttagggtgct

SEQ ID NO: 215 - DNA, 50 bp, Homo sapiens
cttactcaatggggcaggtgtgagggactgtccccaacaggttccagacg

SEQ ID NO: 216 - DNA, 1024 bp, Homo sapiens
ggtctcgatctcctgacctcgtgatccgccccccctcggcctcccaaagtgctgggattacaggcgtgagccaccgcgcccagcctgtttcccccatatctttgggtctttgttctgaaaactcccattcacacacgtcaatcaatttggggaccaaatgccttttgtccaatcaatctgccctctgtgaggtggtttcttagcaagcccacgggtgcagtgtaccgctcgaggggattccagcccaaagagtgcaaacgtgtttgcatctggagtgcgtgtccccagatcctctgccaagctcgttttcaagaatagtcaccactggccgccctggggacttggggagagtgcagtcaagccgagagcccaggtccagccagagtttcctggaaggactgcacagaaaggccggctgtgtaaggtgggggtgggtgacaggagtctcagagtgtcttagatttgggactcctgggggaggatgggcatccacatgaacccttactcaatggggcaggtgtgagggactgtccccaacaggttccagacgcctcctgggttccctggggagggcttagaggatgaagcggcaggaggagatgggatgagttaccaaactgcccagaggtgtgcgagggaggctgagggtcctctggcgctgaggtgtggtggagatgctggaaacttaccactgtcttcctccaggtgaagcagggcctcaggtagccagggaactggttgagcagaggaaatcggagagacctttttttttgtcatgaacaggctcagtgtgaatgggggaacttcctggttctgagggaatgtgggaaaattgccctttaggctgggtgaagaagaaagcaagtggaaccctggcacccctggacttcctcctccagaggaagcggctttggttgtgggccagcgagcctgtgcgtccccagccccagggcattcaccgcttcagagaagcaaggcgacagttctgccggatgagaggatccaggctgactggaggaaggaa

SEQ ID NO: 217 - DNA, 50 bp, Homo sapiens
attcctctttctaatgagagctcttcacccattcccatgtctcaagtacg

SEQ ID NO: 218 - DNA, 1024 bp, Homo sapiens
cccaccgaccagaccggtagccctaaagagccccactctgtagattcctgaggatctgcccaccgtactcattcacaaggaagcccctaaacatggctacattgtgccttagcttcacagccctcaaaatacttctgactcaaatgtcttagggtcagagtaatgacatttagcacatctgcctagaaactcacagttttccaatttgtaacaaacattttgcaccttttaaaaatctcattctaaaatccaaatggtaaacagctttaagaatcaatatgaaatgttttaagtgttctctgtggcttcatataaattctccctgcccctctcatcagaatttattctgactttcagggagcatattaaaggtagaaaccactgatgtacaataataagtgtgcaaccatattcttaagaatctaaattcaatcttggttagctgagaatgcttgaaacagtaataaagtgctcctctgaaagtcacactcaaattttgaattcctctttctaatgagagctcttcacccattcccatgtctcaagtacgcaaatgaaaacaaaacaaaaaaactgtaactgggatttaaaagtataacagtctttcttctctcatgtatttctttcttgtcatacttcattctggaaaaaaataatccaatctgaaatataaagtgggaaaagggaggcatccgtaggtaatgtgagttattatcattgttctagatgttgggttgagtggtgggttcatagatgttcattacattatttaaaagccattataattaactattagaaaataagagggccatacatgcacgagtgatgacagagtgtcataaatcaggaattctgattattccaatcccatgcacctaagatctgtttaaagaaaaaataataatgagatggtgatgcaggtagctaatggttagacccttctagagttcaccaaactccttcggcagggacgtcttcataagcatgcagcctgcgcagctgcacaaggtcctgcctttaggag

SEQ ID NO: 219 - DNA, 50 bp, Homo sapiens
agctctgtttctaagcagtttccctctaaaaatgctatattcttttaacg

SEQ ID NO: 220 - DNA, 1024 bp, Homo sapiens
tgggcaggaagaacaggaacatggcaagttgtgatcatgcaataagtatgctcaatgaagaaatcttactcagtgggactataggtatgaccagaggaagaatttgtccatccaaaagatggcactcaacatagaataggcgaaacagagcatctgagacaataacaggggaaccactcggacaagtgcagaaagagactcagccaatcaagtgcattgaaccaccaccagagcctaatatcattaaatattcatgctatacagccctcggctcagtttcttttccttccttccttccttccttccttccttcttcctttctttttctttttctttctttctttcttttctttctttttctttctttttctttctttcaatagaaatggggtatcactgtgttgcccaggttggtctcaaactcttgggctcaaacaatcctcctgccttgctcttccaaagtgctgggattgcaggcatgagccactgcgcccggcctcagctctgtttctaagcagtttccctctaaaaatgctatattcttttaacgcttttcttcacagaggctcaaagtgccttaaatatgtttaagtctctgaaacttgggatatagggaaagtgaataataaattatcaattgtatgatcaatgatgtaaagtctgatatttttcccgtggttatactattgctaaattgacttttctctccaagaaatcctctgaaaacttcacaccaccacctgaatgcccactcctgagcggtccggtcagggctccatgggaatgctgaccacacttcctctcaggggcagacctgcacggctgctcctccccagtgccgttcttctcttactgcagagactatgtcagcacgttatgattatgatgcagcagcaacagaacaatgcccagagcagcctggcctgtgcttcttttactaagtggttagttgcctgctgagtagacataaacacctgctaaagaaatgtgaaaagagtggaaacgtgctatttggaggttattt

SEQ ID NO: 221 - DNA, 50 bp, Homo sapiens
cgcaaagtttacacagaaccagagataaatagagaagccagacttgtgga

SEQ ID NO: 222 - DNA, 1024 bp, Homo sapiens
gtaaatatgcatggctaaaggggtagctaaagggaggtcaagaaatgaatgcaagaactggctgtaattagtttttgtctgaggcttgtactgattatcaagtctctacatcttttacttgtgaccattaccatgtctgggaccacatagaaagcagaatattgaatactggacctgtatgctcaggtagaaaatcacctgtgttcagcaccagtgttctcttaggatgactcttcctaagaacattggactagtatattatgggggtgttaattctaaaagctaatttttgcaacctaggtctattttttcataaaggtcactttatgactggttctcaggcaagccctcgaaagttctttaaagccttcattgttctcctaaagagaagcagtcctggagccggggtagagcagggtaggaacccaagagcacctagggcttggttattgcccatccccattcgcatctcagtccctttatccagccaatcttgatgtcgcaaagtttacacagaaccagagataaatagagaagccagacttgtggagagaggaggggaagataatacaatctccatctgttcaataagctgggagaggagggaatttgggaagaaaaattcccaattattcatattgcagctctggggaaggaagaatgactgttcttgagtcctaggtgcctaggtacagtagatatttccagaatgccaaaattccatgaagcatatatataagtcagctacatgtaaattgggagcttcttaattaaaataagatatctcttactttatataattatttttcagtagttacttgcctcttttccatagctgggaaatcagtggcaaagctgagaaaggaacctggattaattgattctcagcttggaaacccatggatcagtagaactacaaagattaggaactttcttattcctgattagtagaattagaacattggagctgcatggaatagtctaatattatatacatatcatttacttgcctgcatcttgagtt

SEQ ID NO: 223 - DNA, 50 bp, Homo sapiens
cggtaaagccatgtttccaaggaggtctgtacaaaaagccagacttctgc

SEQ ID NO: 224 - DNA, 1024 bp, Homo sapiens
ctgctcgagaccatatagctcctaagtaccagagtcaatgtttgaaccgagtcttacctgcagtaggagaattatctcagcatgactttgaaactctttctgtgagctgcccaatatgttttgcctgggccctttgactacagtgagatttctggttagtattgtgaagcagttaaataacttaaatttacattaaacatttctggttttactttgatgatgacttaagaaaatgaatataaacatatttagcatcattgggatagccagtttgtaactgaacagatataaacataagaagtttgcatcttattttatattcatgaatattcagaagccatatataacaacaataattaaagtgcaataccagtaatagtccacatattacttaaatttgactaacagtattcttgttgttctagaaatgagatgaccagctctttcagaatatacagcaactgcctccacataaagcagtgccaggtttaggagatttacggtaaagccatgtttccaaggaggtctgtacaaaaagccagacttctgctggcagttactgagagagataggctttccatccatggcagccatttacttttgctctgggagacgtttgtaatagaaaaggcacaactggggtatttattcattccccccgttcctctagtgtttggtggcgttgccgttgcaagtgcgcagggctaaaatggactggttatcttaggatcatggaaaacctggaatcaaggctcaagaatgccccctattttcgttgtgagaagggaaccgattccatccctctatgccggaagtgtgagacgtgtgtcttagcctggaagatcttctctaccaaagagtggttctgcaggatcaatgacatatcacagaggaggtttctagttggcattctgaagcagttaaatagcttatatttgttacactatttccaaaatatccttcagaccacacagggaaaggatttcatctataacaggtcccggatcaacctcagcaagaaaga

SEQ ID NO: 225 - DNA, 50 bp, Homo sapiens
cgagaatgttcaagtgcccgcagtcctaggggtgccctcaagcttggctt

SEQ ID NO: 226 - DNA, 1024 bp, Homo sapiens
gacatggggacaggcccatcccctacccctgtgttctggacctcagcgtcccctccgtggcccctctggccctggcccagggatgccttctgcttcattgagcccatctgtttgagacttgctaacaccttcctcttttgtgactggaagtcacagggccaattgctaagccgtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacagggtaagggggatgaggcctccccttgatcctgcatccccacttcccgccccacagatcccattcccaaatcccaccttggtcccttttctcttctctctagacccaggggctgatgatgatggggaaatcacctacgagaatgttcaagtgcccgcagtcctaggggtgccctcaagcttggcttcttctgtactaggggacaaagcaggtctggagagcctgggggatgtgtgtttgttggggggctgtgtcttgagctggggagtccacaatgtttttgttgttgttcttgagacagggtcttgttctgtcactcaggctggagtgcagtggtgtgatcatggctcactgcagcctcgacctcctgggctcaagtgatcctcctgccctggcctcccaaagtgttgggattgcaggcgtgcgcccccatgccatggccctcagtattcttgagagcacaataccctggggaaaggaggagggcggttcttaggaaacagaagaataggaacaggataaatgggagccaggggaggaagaaagattcctcccgcaaggtggagacccctttcggggagataagggctgcggagggatagggcagccctgtgggggatgagttctaatgggaaacggggagccatgggagggaaaagag

SEQ ID NO: 227 - DNA, 50 bp, Homo sapiens
tacaggatgagttctcgcatctgcagaacacctggatgttctagaagccg

SEQ ID NO: 228 - DNA, 1024 bp, Homo sapiens
atccacaagaggataaagaaatcctgagaaactcactcccgccaacaaaacctttagaaaaagccagcccatggtggtgaaggcaggattccgattgtctggagcgacggcagccaccactagagatttttctgagagcttcctttctgctcactttcaaagcaggaagtctctggggagcaggggtggaatctgcaagaagatgctggtggcagtggtgatggcagtgataacggctataggaatgttgggggctgtagaaatgaggcccccatctggaatcctaattcaaaagaatcaggaaatttgcaatccctcatttggcttgatcttctatggtcagtgtttcctcaccgcagctcagtaaaatgactggtcgtgttcaataattagacatcaatgtcaacaactgctctttggccactaagaaagtgacccttctgtattcagggcctcagagccacagcacaggccttacatctgcttggctgtttgggactccatctggtgactacaggatgagttctcgcatctgcagaacacctggatgttctagaagccgccgtcagccccgaataactgagtagcagatggttgagggcttcatgtttctgtaaggtttcctgaaagaacaaaaattgacaagaaaacagagttaaaactgccagtgcagctgtgttttactcagtagcttaggaaataatcacttttccatgccaacagatgtttttattcaaatatttaactggttcatcagtttctccacctgaaaaatagtgatgataataatattcgcaatggacctatagcgacagggttggaagtaacattagagatgatctctgccaacccactcactgtagagatgaggatattgaggcccagtgttctgggtgggaccaggaccagcccccaatgctgctaaatcccagtgtgccactgagaattccagaaggagaggtgagacccttattaccaagacatggttatttgtaacagtcaagctataacctaatgtttctac

SEQ ID NO: 229 - DNA, 50 bp, Homo sapiens
ctgaggccagttaatcatccccagtgtccaggcacagagtagtcggtccg

SEQ ID NO: 230 - DNA, 1024 bp, Homo sapiens
gttccatttctgggaaataattggacaaatgcctcaaaatgatgtacagggatttgtctctgagctctctttatagcgtttgaaattatttgctaatatatcaaatagtaggagatagcttgtataatcagggtacattggaaccacacatgcccagtggttccttctccctagcacagagatgagctgtatcatatctttttctcaagagaagtgactaacatgttgaagaagaggccaagagtgttaatctagcaaagtccctccacatggaaaatatgaagagtgacagataaacaccctttcccctataaaggaactcattatttcttaaaatttttttagtgagtttgggagaaaaatgtgtttcttatgtgtacacatgtgcttccttaaacaaattgagattttcacactttttttggggatacaggttctttaatggaggagccaatctctctgcacacctggtttcatctaataatatacagacaccagctctgaggccagttaatcatccccagtgtccaggcacagagtagtcggtccgcctcacaatgttggactttctagccgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaaggtaatcttcctctatagcatttttattgttgtcttttctacaaaagcgtgttttctctgggaaccatgaaactctgtaaggttaaggaattatggaaaaagctaaagagaagagcttttcgactaaacttaatattagctactaacttgaaaataagttgaaagtattatgtcaaagccctaacacaatataattgtatttttaaaagataactttgatatttcacattgaagggccccatacttaaaagcatgctaatcttgggtccaattcaaattcat

SEQ ID NO: 231 - DNA, 50 bp, Homo sapiens
cggtccctgccgtccaggaccctggagtcaagtcagaaatggatgtgtcc

SEQ ID NO: 232 - DNA, 1024 bp, Homo sapiens
acaaaacctgaagccaaaggagggaagaggaaaggaaggggagacatgactttttcctggagactgctcaggaggggtatacaaagtctgcatagccattcagccttaaagaatgtgaaaactggccaggcgctgtggctcacacctataatcccacactttgggaggccgaggtaggtggatcacttgaggtcacgagttcgagaccagcttgaccagtaaggtgaaaccctgtctctcctaaaaatacaaaaattagccaggcgtggtcgcaggcatctgagtcccagccactcaggaggctgagacaggagaattgcttgaaccctggaggtgaagtttgcagtgagccgagatcgcgagatcgcgccactgcactccagcctgggcaatggagcgagactccgtctcaaaaaaaaaaaaaaaaaaaaaaaagaatatgaaaacggtgtgcttatggtgtgccggaccacaggggagccacaaagatgactcctgtacggtccctgccgtccaggaccctggagtcaagtcagaaatggatgtgtccacagctgattgtgtgacaaggtctggatttgtgggtgttttcattggagtccagggaccctggtaccttatgtgcttttttgccttgtttctttccagattgctcatttagaaagtggatgtgtgggataacatgtccaatgtgtccgaggagagaagaaaaaggcagcagaacattaaggaaggactgcagtttatacagtaagagcttcagagttcttgtgttcttgccgcgtcctaattctttggtgtggatgtatgttttgtggagaggaagaactctttagtcatgtttaataggtccagttaatttgggttagaaactccatattctagcaatatttttttcttttgtccatttgaacattcttgcattcggaagcaagtgttacttttgctggcttttagggctacaattgttagtctcccccaaaacgttagactgagaaatttgaatttgttctatgaacagtgc

SEQ ID NO: 233 - DNA, 50 bp, Homo sapiens
cggaaggcaagccccacatcccagaggcatccagactcggggctctccat

SEQ ID NO: 234 - DNA, 1024 bp, Homo sapiens
ctccaacctgggtgacagagcaagactctgtctcaaaaaacaaaaacaaaaacaaaacaacaaaacaaaaaaaaagaaagctataggataaatataaatataaatatataacagaaaaaatgggtggaaactgttatagattaaaacatagccaaaagtctaatgtgggacaggctgatttgaacaagtcaactgagaaagacattggtgagacagttggtacagtttgaaccctggcgggctatgtgatgatgttcaggaattgttgtttcagcaggggtgaaggtatgatgcttagttttttgttttgtttttagggtttgtgttcttaaggaataaatcctgtggtctccacaactcaaacaatctggtatttgagattagcattaaaatggtccagcgggcatgtaagggggaaaatgggggctgtgcaggggccatggtgacaaagggaattcctgccggtgtggccaaccctgcaacctcagtggcttctgtcacggaaggcaagccccacatcccagaggcatccagactcggggctctccatgtgcaggagcttggggaggctgggactgccccagtgtgtggatctgctgtgggctttgcacctgctggaccttgcaacccccacggcactcaggcccaaccctcctcacacctcccacctgccctcctgccctcctgcccggctactcacagcgctcctcctggtccacacggctccggccacctcgcctgctccggcccaggccactcattactcaggatgcttattactagtcttagatttgattagtgcttgggctgcacttcctgggttttcccctcaacctgttggatgtaaatcagccacacccactcccgcccccatgcctgtgcattgggtctcaggagcccaggtgggtggctgcggcccaggctcctggcgtcccatggggtacacacagagcagtggaaggcctgccgggccttgcgatgaggtattgactatgggatggcccaggctcttctagatctggcc

SEQ ID NO: 235 - DNA, 50 bp, Homo sapiens
cacactgtatgaattaaaacgaaggcccgggatgcacattgtgtctcacg

SEQ ID NO: 236 - DNA, 1024 bp, Homo sapiens
atccactagataaggattcctaggtatgtggtaaaactatacaaacacttctctacttacaatgtggttacctcctgataaacccatcataagttgaaaatatcctatgtcaaaaatacatgtaaaacacctaacctaccaaacaccatagcttaggctaccctaccttaaacatgctcagaacacttacattagcctacagttgggcaaagtcatctaacataataaggtgtaataaagtgtctaatataccctgtaatttattgaatactgtattaaaaatgaaaaacagaatggttgtatgggtactcacagcatggtttctactgaatgcatatagcttttgcatcactgtaaagttaggaaatcaaagagaaaccatcataagtcaggggtcgtctgtaaagataggcactagaaaggagagtggttaactcttatgtgaagttcatacaagtgggagcctttttggtaaccaacagaactgattaccacatagtcacactgtatgaattaaaacgaaggcccgggatgcacattgtgtctcacgcctgtaatctcagcactttgggagtgtcacttgaggccaggagttcaggttacagtggactatgattatgccactgcactctagcctgagtaacagggactcaaaaattaaattaaaacaataaataaaataaataaatacaaataaaattaaatacagaggttctcagaatgtggtcctccccaccaccaccagcaatattaccatcatctggggacctgttagaaatgcaaattcccagtctccttctagatctattgaaccagaagttctggaagtggggcacagcaatctgtgttttatccagcctaccagataattttgatacacaccaaagtttgagaaccactagattaagggatgagttttactggggaaaggggaaacttacaaaaccaagagaaaacacaggtttcccccttctcccatcatcccaaggagcagcatgctggggccagagtagtctgctggatc

SEQ ID NO: 237 - DNA, 50 bp, Homo sapiens
ctgagagcccctgcagctgcagaggacagtttctttctgctgaaccatcg

SEQ ID NO: 238 - DNA, 1024 bp, Homo sapiens
cagagtgcagcggtgcaatcatggctcactgcagccgcgacctggtgggctcaagcgatcctcctgccccagctttctgagtagctgggaccagagacatgcaccaccacacaaggttaattttttaatttttttgtagttatggagtcttactatattggccaggctggtctcaaactccagggctcaaaggatcctccctcctcggcctcccaaagtgccaggattacaggagtgagccaccacacccagccccatctcttttcatcatggtactaattcctgcccgtccacccacaaaagcactgtagtgcttcccgagtatagaggcctgtgagcctccactagggagagggctcctgcagagatcagataaattgatcacaatggctggggtggtggcaatgtgctaatgctctctttcttccactcaagatatcctctgtctccctcagcctgtgagctttttctccagtgtgctctgccagtgggggccctgcctgagagcccctgcagctgcagaggacagtttctttctgctgaaccatcgcagctatgccccagcccctaccctggaggggtccccaggggccatgggcagcacctcctgtatagggctgtctgggagccactccagggccacagaaatcttgtctctgactcagggtattttgttttctgttttgtgtaaatgctcttctgactaatgcaaaccatgtgtccatagaaccagaagatttttccaggggaaaaggtaaggaggtggtgagagtgtcctgggtctgcccttccagggcttgccctgggttaagagccaggcaggaagctctcaagagcattgctcaagagtagagggggcctgggaggcccagggaggggatgggaggggaacacccaggctgcccccaaccagatgccctccaccctcctcaacctccctcccacggcctggagaggtgggaccaggtatggaggcttgagagcccctggttggaggaagccacaagtccaggaacatgggagt

SEQ ID NO: 239 - DNA, 50 bp, Homo sapiens
cgcaggggcatcccgggcacagcccccaaagccacctgggacccacagct

SEQ ID NO: 240 - DNA, 1024 bp, Homo sapiens
cggcctccggttcggccccaccctgatgggtcaacactctgggcccagggccctcccaacccctggcctctctccagcccctctttgccttgggaccccctgtaagtccttgctggttggatttctcaggcccagccgctggccagggctcccttctcccattctcctgcgctgaggtttccagcagggaagccttcgccacctctgtggctgccctactctggcccagcttaagtcctcccctgcctcagcttttggggtctggctcctgcagtcatgcatccctcctcctgaccctggagccactgcgtggtcactcccagaagctggggacagtgagggctggaaacagcctccatccctcccctcgggctggcctatgcctcttgggagggtccctgaggcactgcctttagagcctggggacacgaaccactcggtggtcaactccagcgaccagagcacggagagcaaggggcagcggggggacgaggcggatgcccgacagctcggcatcagcaaggcagtccaagacagaacaaggcacccgacgggtagaacgcaggggcatcccgggcacagcccccaaagccacctgggacccacagctgtttgatgtgctcaaggctatgaccccaggcttcgagaaaagactccaccaagttccatgagcacctgtaggagagccggcctctgggtagatttcacccaaagaagctaaaacgctcacgtggtgcttatgggatcacagacgtgtttgtccctgatgctgcaggagaactggccactcacaggtggacctgatggccagagctactagcggggaccaggggtaacatgggtccccctccccgagccatgaagagctgcctgcggccatcttggccctcgcaccccgtctctgtcaccccaggcccctgtaacttgcttaacgcttcctgaggggtggtttgggtttttttttttttcttcctctcctcttgtagcaacagattaaaaaacaacaccctgacccaagccgaga

SEQ ID NO: 241 - DNA, 50 bp, Homo sapiens
cgctcccgcccctacgacccaacctggaaggccccagaccctgaaggcgg

SEQ ID NO: 242 - DNA, 1024 bp, Homo sapiens
cttctcgccgcgcgttcgggctcgcagccctcccttccccctcccggacccagtagtcccagtggctcccacgcccggcgccgagctccaggccccgcgcccgccacgcccaccccgcgcgctagcgcccggcccggcctcccccaggtaacccgcccgccaagcccgcctgggcgctcccaggccgcccagccgcccgcgccgctgcctccggccggctccgcgcccagccccctccacccactcgcagcccacccccgcttccccaaacgagaacctccaaagctggcgccccagggggctggctgcagtcccgctcagggcccacgaggggaagacgcccctcctacttctgggatcggttcctggtgggagaggcaaaggggagcagccccagggcacagaggaagaagcaggttcccacaggctcggcccagcccagctgcgggagttagcccagagaagggagcagagctcaggtctcagggctcacctgtccagccaggccccagactgctcttctccctccaccaacctttgctcctctctcgcagcctgtgcgctcccgcccctacgacccaacctggaaggccccagaccctgaaggcgggcccactctcttctccttctcctctcagttcctctctctgaagggcgttctaagggacccgggggtccagacgcccaggccctgattcccctgggctcccaacggagtggagtgggagggggactcaggagtcctcagggcaagcctccctcaggcccagccagctctggccgtagtgggccagagggtctgatcactggccagaagaggccaaaaatgaggccaggacaaagttgagtggtcgggaggaggaagaagaggagcaggagaaggatggaggcacactgaaaatcacacacagtcaaaaggaaggggaccaagagacccagggaagatgaaacagtgagactgagtaggcaaagcaactgagagagctactgggcagaggatggagcgggacagaacagcttgtgg

SEQ ID NO: 243 - DNA, 50 bp, Homo sapiens
ggcccaagccttgtttctaagaatcagtctggctttaggccagtcagccg

SEQ ID NO: 244 - DNA, 1024 bp, Homo sapiens
gggagagggcagtaaggaggacttcctggagggggtgactgtccagagcctggaactgtgcccacaccagaagccatcagcagcaaggtaagtgctggaaaaagtgggaaccccagccccatgccctgtccctttgccctaacctgcatctcttcgagtaggtaaaaaaaaaaaaaaaaaaaaaaagggaagatatttttaacaaaacaagatgagaggaggctgggagactgtgggtgatgtcagggatggaggagccagttttctcctttcccctgctctggggtgagtggcctccacctcatcatccctgctgctcctgccttcatcaaacaatcctcaggggtttctgggtgctgactgggggcctccaaagcacagcacagtcaatggggagtggggagagctgggaagagcgggagaggggaattgggagaaggtaggcagggtacacagaaagcaggggactggggacctcaggaccatagccgctgttccttggcccaagccttgtttctaagaatcagtctggctttaggccagtcagccgccaggcaacctctggggatttaaatggatttgcaaattttctagattcttaagatatccttctaaacccccagcagctagaaaagtttgagggctaggaaagttcgagggtgatgggcggccatggcaaccccctagcggtcatgctgctgggtctgggggctgggacctggctgtcagatctgggggctcctctgtgaagaaggggtcagccactgggccatttcctttggtcccaggcagctgctcaggcctcctcgttgtctccctccttctggactctaccccttctccatgccattctaaagcataaatccaatcacaccacctccctgcccaggatccgcctatggctccccagtgcctggagaaagtcccagctcctaacagaggctgccactgcttgacacttactgcacgccgcaactgtgctgagtgctttatgagactgatctcatgtaatgctcaccagcaa

SEQ ID NO: 245 - DNA, 50 bp, Homo sapiens
gttcagtcaccagggcctgatggccgctcatgctcaatatagacttggcg

SEQ ID NO: 246 - DNA, 1024 bp, Homo sapiens
tctgaactgggataattttacctaggctgagattttttggccatctctttgcgcctctgatacaccatctggatgtgtctgaccttctccaaggcaagggcagagaagaagccttctaccttctaaggaagctattgttcagttcctagcccttgatctttcctttgttttaactccatagcttgagcagcctattcagtagggttaattgaggaagtagagtggggtttcctgtctgaaagtggacagctaattcctaccagtgattcgggctctttactaaaatagtgaaagaaaaatcaccttttttgatgtagcacctcattggcttgctctaggaaaattccttcagccctggttcaaaattaagtaatgagtaatgagtatgggttatcaaaaaaaaaaaaagccaattcccttggagctaggtgcagcacctagttcgtaatgtggctgtcagagtgtaattctgatggggtggaaactccatcttgttcactgttcagtcaccagggcctgatggccgctcatgctcaatatagacttggcgcggagcggagtggaggaaggaaagagggcaggtgctagttggctggcctgcagttagaagggctgaataaagtgctgtagtgccctaggcgacatattcatttagcagatactttattgtgccactgtggtcagtgcctttctctgagaaggtgtgtgtgtggggaggggctccctaaaggatgtcatagagtcccacatagaaactttgaacaatccaaggtagacaggtgtttttaactcataatactcctttattccctgttttaaaaatttttttaaatttgatacaataattatacataataatggagtaccatgtgagattcaatccacatatacattgtgaaatgatcaaattaggatagttagcatgcacatcacccccaaataattattacttttgtggtgagaacacttaaaattgtctcttttagaaatatacgttattattaaccatagtcaccttgctgtg

SEQ ID NO: 247 - DNA, 50 bp, Homo sapiens
cgagatggtgttcctggtattcaaggagtgagaaccatgatcagctcttt

SEQ ID NO: 248 - DNA, 1024 bp, Homo sapiens
acagcccctgccgggtatgcttcaggctgtgagtggagagaaactgctccctgcacctgtggtggccacaattcccctgagaggtggctgcttgggtgggggaagaggctggttcaagggctggctcgtcactgctgagcctttggaaggaagcctagggaacctgagtcctgggcatgtgtcatgggcaggtgatggttctgagcttgacctctccccctgcctggacttgggcaaaccttgtcccttccctgaccccatttccttgcttcttgggattagaaacaaggacttaaaggggttgtcacatgcacagaaatggcccacagtaggcgcccagtaaatgttagtcactataaatactcatgaagaataaataaggcaggctgacctgtggctgactacccgtgtgactaggtgggcactttgatccttcgaagcttgacatttttcatctgtgagatgaggaccagaatgtctccctgtctcattatgtgatacgagatggtgttcctggtattcaaggagtgagaaccatgatcagctctttactggaattctttttttaaaaaaacaggccagctatggtggcttatgcctgtaatcccagccctttgggaggctgagacaggagaatcacctgaggtcgagtttgagaccagcctggccaacatggcgaaaccccatctctactaaaaatacaaaattagccagatgttgtggcacatgcctattattccagctactcaggaggctgaggcaggagaatcagttgaacccaggaggtggaggttgcagtgagctgagatcacaccattgcactccagcctgggtgacaaaagcgaaactctgtctctaataataacaataataacaacaacaacatatatttttcttcttttttttttttaagagggatgggatcttgctatattgcccaggctggtcttgaactcctggcctcaagcaatcctcctgcctcagcttcccaaagtgctgggattacaggcatgtgccactgtgc

SEQ ID NO: 249 - DNA, 50 bp, Homo sapiens
tggtttgctgcagccgaagctgcttctctctctttgcactgtgcttgccg

SEQ ID NO: 250 - DNA, 1024 bp, Homo sapiens
gaaaggctgcagccccgtgatgtgagtgctactggggaagcctgctgggtaccctgggaggcatggcaagtgggcatcctcagagaaaaaggaaacactcactccccaagctcgagatgtcccctcttcttgcaactgcttgttcagccagattcccactaccggcagagcttccggaagtgacttacctcccctggcgcctccggctgccctgaagtgtgatttgcacggggatgctgaagggctgcatgaggccaggggtctgagaaaatggctccctttcacctgagtcatgcccctgcgggcgcaagaaaggtgaagcttagacatccacggaagtggagtcccagcgggagcccccagcccccagcgcagctgcagccattagaagccccccgccttcctggagaggtgagaacttcaggcaggctagccacgtggttctgcagactcctggcaaggcggagcggtcagttctagatgatcaagaaggacctgcgtggtttgctgcagccgaagctgcttctctctctttgcactgtgcttgccgccacctcatcacctgtgtttccgcctcggcagccgggagcatcgccatagagacctcaacgcttgtggaaagttctgaggcccaaggggaccctctataattggtgagggacgtactcagttcaaggtttataagaagaggaaatgttttgccctggccgcgtttccttttccacgtattgtctgttagagtgcaagctgaaataatgggttttctagttaatggcatgttccaattaagataattcgcttttaaaccatatgtgatttcccaatttttcaagatacaaagggccataaaataactcgccattaaaattatctcaaattttaagaaaagctgtatcaaatattattttatctttctctgatgacttaaaagacatttggggatctttccacactcccaaattaggaacatcaattaccattatattatagtaccacacattgctacaggcacctgtagatgtgg

SEQ ID NO: 251 - DNA, 50 bp, Homo sapiens
cggtcggctgacaccgacctcaggcagccctgcccaaccacatgccagta

SEQ ID NO: 252 - DNA, 1024 bp, Homo sapiens
gatggtgtcggcctgcgtggagatcttggcccacatggacacaatgatggtcctctcagtcttggtcagagacatggcggcagggtgggcagctgcactggagttgggcctgctcaggactggccttggtagtgctcagcccccagggtccccttatatacagggagctgggcccagccaggctgtggccattggtcaggtgaggggagggggctgcaggggtggtgtttcttatcagatccagtgacaaaggggccctcagggcctggtgggactggggtttgggggctatcactcctgttcctctcctgtggccttacagggggtgttggccagagtctgaccacagagtctaggagagataggggccccaccctcccaggaagtcactcctgcatttgtagtccagttctgcaccgtccttattcatttcagaatcacgacttgggggaaaccagaggagcagggcccagtaagcagcctcctgggaccaagccccacggtcggctgacaccgacctcaggcagccctgcccaaccacatgccagtacccttccactttgtctctggattcctgggtttcctccaagaaagcaagggttaggtccacccagcgctgaggggagatgtactggatctgtcccctgacaagcaggaggaggcagcaggtccggggacaaaggagaattcacctaatgtcatgtgctaataggcattgcaatattgctttccatattagttattgtaacataatgaggcaaatattccttttaatttttttttctttttttgagatggaatctcgatttgtcgcccagggtggagtgcagtggtgcgatctcagctcactgcaacctctgactccctggttcaagtgattcttctgcctcagcctcatgagtagctgggattacaggcacccggcatcatctctggctaatttttgtattttcatagagatggggtttcaccatgttggccaggatggtctcgatctcctgactcctgatccacctgcctcagc

SEQ ID NO: 253 - DNA, 50 bp, Homo sapiens
ctgagcgagtccagcccagggctccggggaccgtttgtagttaggatccg

SEQ ID NO: 254 - DNA, 1024 bp, Homo sapiens
cattttgggcagaaaatgtactttatttgaaactgagcaaatgagtcagtctcaaaatgtccattcaactaatatgtatttgagttgtgcttgctttttaagatgttttgaaaaatgctgaattcagaattgaattttgattattgaattgagtattttttactcttgttaaaagttaatatcaattttattgttgtactccaaaatatttttaaaaacttgttacaagaggaataaataggctttaaaaaacacttgtcttcaagaaaacaggagagtctctgacaggtctctacttctttgagggtcctctaactccagcacccacttctgtggttttacggggcttattccgcgcttccacccgcgaagaaggagcggttgcagccgcgcaggtctcgtccagagcgcgatctcgctgctcttcagcgcgatctgcggctcccgcggcgtgctccgcggggtctctcagggctggtaccaggggcgtgggggcggggctgagcgagtccagcccagggctccggggaccgtttgtagttaggatccgctgtggcgtcctgagtggagtttgggaccccagggagggagggtgtgggcgttcgggtccagaggagctgtttaggtgcgtgtggaagggagctgcatgtggcggtttttctctgggccggcggctctgagggggagcgtgtgcgtgggtgggagggggctggctggccctgcccctcagagcgaccggagtcgccttatcccctgggttggtgcggcccgaggctgagggcgcggcgggggatgggggggatgcggtgttgcagcctcgggcgaggggaagccaggacaggaggctgtgagggtgggagtcggccggcgaactcccactgcgggaggcgcacgggctgtggttcctgggctctgaggggcacggtagacaggaaccccgcctcaggcgtatgccgtaatgcgaattggctgttctgtgaaaacctccaatttttttattcttcgtggtaaattcgtaaatgcg

SEQ ID NO: 255 - DNA, 50 bp, Homo sapiens
ggtgtctctgatcttgctctcttcggagggatggtgccccacgaagttcg

SEQ ID NO: 256 - DNA, 1024 bp, Homo sapiens
gcccaggaatgacaagaactaggaaaagagagataaatcacttgttcgactatatggtttctcagaactgataataggtaaaacagtatttgacaaatctgtgcacacacacatattttaaaaaaaatcctccaaacccagtcgcatgaaatattctagaaagaggaaaatcggggagttttagaagccattgagagaaaagaaagaaacaaagtttgcaaatcacaagtcaattcattctctgcaagcctacctctctttctagcaaagatccaggtttcttcaggcgggactctccctccgggtttccatggatgagggtagggtggggtgaccacccaccagtctccccagtgtggcaaccaagctagagacgctggctttgctctcttgcctttctggctaaggccggggagtgggctgggtctcctccccctgcccctccaatgggaaggacctctcaggttcctgaaagaaaaagggtgcaggagagctgggcgggtgtctctgatcttgctctcttcggagggatggtgccccacgaagttcgtgccccccctcccagcccccagctttggacgatctcaacagcagagctttcttaagaaaatgcttgtcatggcaacagctctagctaactcgggccagactcttgctcaccagctctccccaagcagtgcgggaagagagaggggaggagcaggagctggaacagaggtgggacttggcgcgaggccaaaccattactctactgttaaggtggcccgattcttgcggttacttcctggttcgtcttaagggggaatgggaaaagaaagggaagcaatcctctcccctgtcggctttcttccccgcccttgctctcacttgttgaatagaaagctgagtaggggtggaggaggggtgagggtggaggtggggagtggatgtgggtggcggtattcaacggttgctgggcggaggggaaaaaaaaggaagcttgggcaggcggctggcttcctgcagctcctacgggcctctcaac

SEQ ID NO: 257 - DNA, 50 bp, Homo sapiens
ctgactgctggctgaggcgcagcacagccttggttaaatccttaattgcg

SEQ ID NO: 258 - DNA, 1024 bp, Homo sapiens
aggagctagcgtagctatagtcggcataagctttggctgggtagctcccggcggagccgttcacgccgtgatactgatactggtaggggttgagagctttgccataggaagccgaggtaggagagcagtagccgtgcggggctccccccgtagggctgtagtagtcagaatcggtagctgaagactcgggcaaagttggcgattcctgagacggatggtgcatagctgcggacgtctggaacggagcttggaagtcgccggatcggatgctggggacccttctgtcaaacactcctgtcatcgctcacgggcggcggcagcggctgtccttgctgttgtggcggcggcagctgccctagttggctgtggggctgctctggtctaagcagacatggctgtgggagcgagggaggaggaggaagaggaggaggagagaaggaggaggcggcggccgcggcgaggaggagactgggagtcgtgaagtctctgtctccggccggctgactgctggctgaggcgcagcacagccttggttaaatccttaattgcgcgcttacgcacagcggggtggatctggttctattggccagggcctcgggagcaacagtaacaccctaactcgtccaactagttttagcacaacaaagcattgcttaaaaagggggtggggggtactgagggggtgtgtgtgtttgtgtgtgtgcgcgcccgcgcgcttgtgtgtgtttttgcttgttgtggagtggggaggggtcttagtctatctgtttttagtaaattccaaagacatcgcagaagccacagcacaaggctctgtgatgtctggggacaatgtgttccaatcagaagcctcaaaagtgcacatgttttgggaatgaggtgggcgaccatctttccttgcttcccactaccccgcccccgtgggctgcaccaaaggcgagtgtagaattaaacactgatactgaaatagggagtcaaggtgcagggagtggggagcggggggatgtaggatggaggcaagaag

SEQ ID NO: 259 - DNA, 50 bp, Homo sapiens
gacgaatttcaattctaagccccgggttttagacggtggccaggattccg

SEQ ID NO: 260 - DNA, 1024 bp, Homo sapiens
agcctgggagacagagcgagactccatctcaaaataaataaataatttaaaaaatccctaatatgtaagctataattattattagatccctacaattgaaataaaaactaataagatatttgtgaagggcattgccagtcaaaacaatcatttatgaattactggtaatctcaggtttcatttgtttacctggttttgctcccagcgtcccgaggtaattaacagcatgtaaatgtactgagtccctgctatgttgtcactaaaataagcatgttcatacaaactaattatctttacatctctaccattcagccctggaaaccgcgacagtaaagttaatataattctgggcggggtatgcatatgagaggagtggcataaaccaatttttgcctacgtaacagttttatctatgattgttcctggaaaccgcaatgattactacatgtattgtggaaatgctgtgactcccttcccttcagcacaaccaaaaatataaagacgaatttcaattctaagccccgggttttagacggtggccaggattccgctaccgttctcacctcctccgcagatagcgattggcggccggatgcaatcattcaaatgaagcgccgccgtctcattggccaggggatgctgctcaccgattggtcccgtgacgaggagggcggtgcccggaggtcctcattggtggaggcggcaagtttaaacagagtcaaaacgccatacttgtttggctcctctttttaatttgcgagtttattgggcttgttttctgttttctagggagtaggttagtggaaaagaaaaagggccgaattcactcccacgacctctacagccgcccctgaggggaagcggtcagcgtaagtcccggatccccgctccggagccgcctcgtgggagcggggcaaggagatccaggaggggtctcgaatctgccatggcgaaccggcgagtggggcgaggctgctgggaagtgagcccgaccgagcggaggccgcccgcggggctgcggggc

SEQ ID NO: 261 - DNA, 50 bp, Homo sapiens
aacgcgggcttatcgtggcctttaaaatccggcttggtgagcttgggtcg

SEQ ID NO: 262 - DNA, 1024 bp, Homo sapiens
tctctacagaccgcaaaactcctccggtggggggacgaggagggaggaggtggcgagtcagctgcgccaacgactcaggaaaggaagagaggtacaggaagggcgctgcctagactgcgtaccgaacgctgacaaatgaagttcacttcattcaacaactcaaagcggcactcagacttaacgcggccataaacgcggcggaaactacagtgcccacgatgcaccgcgccagccccgaccgacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcggaagtcggccatggactggaaagaagttcttcgtcggcgcctagcgacgcccaacacctgtccaaacagtgagttttgggaggggcagcccgttgggatggcccggccctaaactcctagaggtaggggggaggtggggaggaggagcaagggggagccgccttttccgcttctgtgaaacctcccgacaaaggaggcggagtggaatgtggtttaaggatcccgataggtttgac

SEQ ID NO: 263 - DNA, 50 bp, Homo sapiens
atcttggattgtcacatgatcagctagaaccaagtctcgcgagaacaccg

SEQ ID NO: 264 - DNA, 1024 bp, Homo sapiens
tgcctctgttccaggcccgtaggcccagtctattaactttctcactcttacctgatgcctccgtaggtagccgaagtctgcggatgagacagcgacccggtagccaagtcccgtgagaatccagccaccggcggcccgagtacatgcgaataagcctctgagcttgagccaacccccttaccgagatgacgcagcagcaggtgcgggtctggattggagtagagtctcgagtggagagaggccggacatcggtggccgaagtctgagagagaagctggccctcagcggctgggtcggtaggaattagggcagagttaggagcggcctgcggaggggcccgctcaggccgatgccggtagtggaaacagaggaagccaccgccgcgctcttctcggaactggctaaaatagctccgtaaatgggccgagcgcaacacggaggggataccgctcactaccaggtaaactgtcgcctcctcctccgcctcgccgggcaccgccatcttggattgtcacatgatcagctagaaccaagtctcgcgagaacaccgcgagcaacgttccagcccctgcgttgcgagattgtgaaaattctaactagtcctttgggattggggttgtggaacctggagctggaagatccgaagtcttctgtgttcctttcccacagagggaagccggcgatgatggaaaaactcacctggaaaatggggtcatagagttctttcataaagctctcatgaggaccaaataagaagcctgcgggaggggtcatttttgaggtatttagttgtggatattgcacacctaatctcaaccttcctcagttctgaacctttagtcgttcttccatttatttttccaaaatgtgttgatgaactcccacaaatcggtaagaaaaagataacccggtagaaaaatgggccgaagatacttcgcaaaagaggaaacacgcaggtccaatttacaatgaaagtgctatgagttactagaggcttacgttaaagaaaagatgcacaactcaa

SEQ ID NO: 265 - DNA, 50 bp, Homo sapiens
tgaaacgaacaccacagggacagacttccttttgtccttttttctcttcg

SEQ ID NO: 266 - DNA, 1024 bp, Homo sapiens
ttggtctcagggttcccttacggtcttaaatattattgaggttggtctgagtgcagtggtgtttacaactaactgatcacaaccagttacagatctttttgtttcttctccactcccactgtttgacttggctagcccttgaaaaataaaaatggaccgggcgcggtggctcacgcctataatcccagcactttggtaggccgaggagggaggatcgcttgagcccaggagttcaagaacagcctgagcaacatagtgaaactccgtctctactaaaaatacaaaaaaattagctgggcgtggtggcgcgcacctgtggtcccagctactcgtaaggctgaggcaagagaatcgcttgatcccaggaggttgaggctgaagtgagtagaggctgtgattgcgccactgcactccagcctgggcgacagactgagactctgtctcaaaaataaataaataaataaataaataaataaataaataaataaataaataaatagtgaaacgaacaccacagggacagacttccttttgtccttttttctcttcgtgcagagtaacgcggagtcttgccgtaacccaagatggcaaccatctctcaaatgtcacgccgtacaatgacgtcacacagcgactatgcctttcctccctgagagtttcgctacatttcccaggatgctttgccaatagcgacgctattagtcgtcatcgacggaagtgcacctgactgagcggaagtaggagctctcagaggctaagaaggtggagaccggagaagctgtgaggttgtgagtaaccccgtgggtctaagcgtgttggctgtgaggaacaaagctagggaataatctgctgggaagcgcgaggcatcacttccctaactgtaggagctcaaactcctgtgttcttccagtagacctgggagcgaagagaagcaagacattgctgtggaggcgaagtctccgtattaagatcttgctggttttttaagttttcttggcacatactagggcaaattcagactctt

SEQ ID NO: 267 - DNA, 50 bp, Homo sapiens
cggatttcagaagctaaaagcctacgaagccaccgaaactggaaactctg

SEQ ID NO: 268 - DNA, 1024 bp, Homo sapiens
gccgatgaggagagggccaactgtgctttggcgtctcttgactccttggttgccatggctctgaagctccaagttagcaggtgtactaggcgttcagccctgaaccaggcagtccagtactttggctttctgcccagcaaaatgaagataaacgcacaggattttaaaatgtacagttttgaaagcttaaagtttctggacagtctttaaactgtgagacggaatcagcagcacggcttggacttcaagttttcatctttttgttaagtacttgagaaatactgttagaaggatcctgtgcgctgtcagcaagtaggacacaaatgttcggcattccgttaatacataaagccttcaaagcaggggcgacgcgaggggcactctctacagaaagtattctttcaccgccgcccccctccccaggtcgaaatgtttcggaatgctgagcagccctaccagtcaggctaggtacttgaagatgaatgaaccgccgcttttagcggatttcagaagctaaaagcctacgaagccaccgaaactggaaactctggcctgtcggctacttttgctcgtaccagcaggtgtgcactgccgcgtcaatctccaacaaagccggaaaagcagcctggcgcatgtgcaaaggaagtccctcctaccactaccgagccgagatgaccaatgggagacggccatctgcgcctgcgcaaaaaagtcgccaatgttcatttccggtctttttcgccccgcccttcaaatgcgaaagcgactgccttcttgggtgagtgcattagctgggtagggtctgtcccggacctaactggatagtgtgggaagcagtggatcgttgtttcaaaaaccatttctttttggaaattgtcacagagaaggactagatttgcggatgcctaccttagctgcaggcttaggcccacacctgacgcgtaagctgcctaaacggcagctaacgtagatccacccagacgccggaaacgggggaagctcctgctttgcatgggttccgctc

SEQ ID NO: 269 - DNA, 50 bp, Homo sapiens
tagattcactttcatgtttcagcctgattttttcccactgtatgcccacg

SEQ ID NO: 270 - DNA, 1024 bp, Homo sapiens
ggccctgcattttccccattgtcatgttagtctttgagctgacaaccagaacaatggcttcttaacctaccccaaataattttgataaccttctattctcatccttttttttcctttttctttcccatcttgtctttgaaagtatcagacctctgaggaaaggctattgacatttgatctgattatcgttgctagagccacaaagagaaattttatttctaacgttgtttttttcttttccccaagaagaggctttctctttgtatgtttggaagaggacaacatatttggaatcttgagatctcagatctctgtaatgagcagtttgcctaagaaatcatgaatccagattaatcacttttattccagcaaaaatgcaactctcttattgcattgtgtaatcttattattatgctcacttcggaggaatagggaagtccttaccttgtttcgtcttgcaatactagaatttccttgaaagcaaagtgaacctggagtgatagattcactttcatgtttcagcctgattttttcccactgtatgcccacgcgtgtgtgtatgagtgtgtgtgtgtgcgtgcaggcacacacacgcacactcacattttcctttctgcctcccctttcgagctcttcctgccttctctatcatgcgcaggcccctggcagctcgtggttggcaagagcacgaacccgtggtcagatgcaacgtcctgcctcatgcattttcctcttggtgctttggtcagaacttccccaagtggagtgaaactcaggagctgagaaaccgagtcactgtgaaaagatgggaaattatctcctgcgaaaactcaggtgagtcttgactcttggtgccgcctttcttgggagaaagagaacagagataaggaggctggacataacgcatttgtaatggtgaggtacattgtgcttctagaaggttaagcctgaagacagcatcctctaggagcacacagtgacgcccagttggctccttctcttgccttactctggaacaatgata

SEQ ID NO: 271 - DNA, 50 bp, Homo sapiens
cgcatggagcatcccgcacactaagtgcctagtcagccaggtctctgcta

SEQ ID NO: 272 - DNA, 1024 bp, Homo sapiens
atcaacaataaacaagtagtttcaagtcccccaactggctcaccatcttggctgacgaaaaataccccctctcgtgggaccgcggccaccacctcccgccgcaaacgcagcagccagcagccccaaggagcgcacctggctgcgcgcgctcgggtgtttacgcggcgtcttggcaacggtggagctgcgcgccctccgctcgaccaaaagtgacccacgcagaacgtggcctcccattggacgcgataagatacaatcggcattgagcttcttaggaccagggcaggagggctacttctataggtctaaactagaaaagcgggaagttcagactgtggcctgacccaagcactttgcagtgggctagggaagctcgatttccctccagcggccgaactgtggtttcagtgggtttgggagccaagttcgggactgtggagactgcgcacagagaaatacgcaaactactgcctaatgcatggagccgaaggaaatttccacgcatggagcatcccgcacactaagtgcctagtcagccaggtctctgctagggacgatgactggtttaatcctcagcaatgggagtccaggtcgctgtcccctttgctgggttgtgaggcactgagggtagcacgagcttccagcagccttcacttcacccccccgccccccccccccccccgcagaagctgctggtaaattttgggactaaaatctatgagccacatgaatcttactctgctatgtggtccaggtaccaagagagagcacgttacatgatggcaggatgttgatctggttcattccataggcaggttagacactaaagtccattttaaatgggaagtttaagaatgataatggatcagagaaattagatatactgattttagaaatgatacattcagagaaatcttgtcaacactaaaatatttgtataaggtgattagtggtataactttgtgttattctaatttggagtccgtcttctgtagcaatatgtctgcttaaagattaataacaa

SEQ ID NO: 273 - DNA, 50 bp, Homo sapiens
acttctcttctactactaccgttagattgcatgtctcacattccatttcg

SEQ ID NO: 274 - DNA, 1024 bp, Homo sapiens
atgcgagtcctctccgggggctgggatcgagggctggtttgggggtgggggtggggcggggagggtcggctgttgttgtgtgggtctcgctctagcacaaagttaaggatgaaggtgaaaaggaggaggtttgaaggacttgggctctccctggcaagtacattgatcaaagattgagaggggaatgacagagagaaaatgagctgaaaagtgcaggctgccggctggacgagttgttgttgtcacacggtgcagaggggaggagctccggaaacttgaaataccctttgaagccgcaaaaacctcactcactagtattaacccaaattatccaaccaggaactcggagcagagactccgagagcgcgagacactggagagggagcgtgcgaggaaaggaggaggggagggggaggatacggaaagaaactgtgggagggacggagaggaaaagccggggacacagaagtggcgatcggaaaaggagagggagatcatctacttctcttctactactaccgttagattgcatgtctcacattccatttcgtccgcggggactggtaattttttccaaagcttctaaacaatcgcccgccaacttaaagaggagcctgagcgcgccgagctctctccttccaggatttaggatccatctccacgcgttttggcaatgagctagaaacgaaaacacagcccccacttcacgattattcagaaattattttgaggaaaattcacatgtaagcaaagcgtaatgttcttttgcatctgattgtttatttctctactaaattatttatttatataaagatagtgaaaattccaggacagttttcaagtggtgagaagaaagtcagtccgaaatcgcttaagaataatggaaagctctgtattcaattccatatttcctaataggttgtggaaagaaatgcttgccttgatgtggatgatttagaataacttcactgtctccccaaaagccagtcagaaatacctgttaaacctagagctatcaaggaga

SEQ ID NO: 275 - DNA, 50 bp, Homo sapiens
gcaggacagtgaggtgaccttcgctgtggctgttcctggggactctgccg

SEQ ID NO: 276 - DNA, 1024 bp, Homo sapiens
cccgcccaccgccgcgcccggccggcgctcattggtcggagcgaacggccccgccagcgccgcccaatcggagcccgggactcccgccccctcctggactaagggaccgcggtgggcggcgcggtaggggccctccctcccctgcggcggggccgacctcgccacgcccccggcgtcctggggtccccgaagtccctcccggccgcggcgtgggcccttctcctgggcctgcaggggaccgtgcttccccgccaaaccctttgcgcccccatcccggcctgcaggagccagagcgcccctccctcccgggcgaggcgcggtgcgtgcgagggaggggcgaggcccggggaggaaggccttgaatggcaggcccaggagtgtagcttctgcggggcgggggcagagaggccgagaggtggcttagcacagagtgaagtgcttgctcggtgagccggcgacaggaatggcctagcgagggccgagggagtagagggaactcagcaggacagtgaggtgaccttcgctgtggctgttcctggggactctgccgccacctcttcccctaacgcctccgcgtgtgaatcctctggcaccaccacttgccccatatccttcccccaaatctaacctcctgcgtccctgtctcgaagtggagccaggagcctgggagtcacctgctgcctccctgtttcctgctccaaccagtccatctccaggccctgccatactgcctcttaactatccctggaatcggcccactcctctccaccccacttcccctcccttagctcaggctaccaccatcttgtccctgattgctgcagcagcctcctccctggcctccagccccatccagtctcacctcctactagcctttctctccctggcacccagagcaagttttcaggaacacaagtccaccgagaggcattttctatggctcaccgtgagaataggtctaatcaagccctgtatagccttactcccagccacctgcctgtttaacgcctactcgtctttcagg

SEQ ID NO: 277 - DNA, 50 bp, Homo sapiens
cgaaacaaaactaaaagtagttttgagttggatacctaagtacccaggtg

SEQ ID NO: 278 - DNA, 1024 bp, Homo sapiens
gtgtacaaaataattttttaaagccttaccaaatacctactcaattttcacatccacagatgtggtcagcgttttccaacgctcctgattctcctggatttagccattttacataaaatcctcagttacttatgcaaaagacccagaaatcggaacatcttgaccacacctacctgcttctcacacgcagggcattttactcgcccacactgaggagcctcttggagcgtctccctctcagcgtcccaggaagtgcgttcccagcgaggtacaccggaggcttctgggagcgcagtcaggttttcccgtggccctgaacggcaatgccctggatggctgggactacaattcccagaatccactgggccgccagccgcaggcaacatcctgcgaccacctcctgcccttccctttctctgcctccacctccccggatttctcttgcaccttatgttccgtctagaattgggttatcggttaaagaaaaaaaaaaggcaaaacgaaacaaaactaaaagtagttttgagttggatacctaagtacccaggtgacttgaaggtgacttgcccgtaggaaggttagcaaaaattcttaaatctggattttttttcccctcaaagtgtttatctaggcaaaaagtagaaaaagagctcaaagtctagaaccaaacagcccagatttgtatggggctttgctgtgtattgattgggtggccctgggaaagttatctctacatctggaggttatctggaaaaatggggataagatcacccacatcatactgttgtcttgaaaactgagggacctaatatagctaaagtacagtatagctagctattagatatttgaactaattttactctcccacacaatttctactgtcctgtccctttctctgttggcttctctccaatgtgaagtcctgcattagtgaatgaatatctgaattaaactaaaagattccaaagtcctaaatagcaatgatctgattttttaaaaaataaaggatgctgaagtgttgtga

SEQ ID NO: 279 - DNA, 50 bp, Homo sapiens
cggctggtggcagggaaacttaaaagcaactatcccggtcagccctccta

SEQ ID NO: 280 - DNA, 1024 bp, Homo sapiens
ccacaaaaacaaaagctctctggagtcctgaactccgaaagtgtaaagtggtcccaaggccaaaaagcaggagaaccgctgctgaaaagtttttgctcctcctgcaaataactgcgcagaggatatctaacccacttctctggcttgagaccttcatctaaatttggatgccaggaaagcatctcaatttagttccatgggaagagtctgatatcttgcaccagctcagcctctaattttcgcgaggcaaatttcctgtcttctctgagcctcagtttattttgcaagcgtgaaaggaggggttttggaacatacgaagtacaaaatcttttccagctctgacattctacgattattcttgttcctatctttgcctggactcactaacttatatttaattccatgagagaattctgataaaactagcccctttctcgtcactttcctgtaaacggcgcgaggtgagggataaatatcaggaaaaatcctgatgggcagagcggctggtggcagggaaacttaaaagcaactatcccggtcagccctcctagtctccctagccaatccagtacctgccagaggcgccggcacacagcaccgaacgctgtccgcgccgccatcttgccggtcccgacctctcaggattgcttccggggttacagcggcgtcctcagaccatagagttccgcaaaagaagagagtacatcctcatgttccggcgctggaacaaccatagagacatgaacctgtgctttttgggggcgggacagttggctggccaggctggtttggctccggccagtgtctggatagttaccaagccctattaatgttttcacctttaaattgttgtgtgtgtatacacacacacacacacacacatttatttatttacttattttttccttttagagactgagtctcactcggctgcccaggctggagtgcagtggcacagtcatagctcactgcagcctcaaactcctgcctcaagtgatcctcctgcctcagcctcccaagtagc

SEQ ID NO: 281 - DNA, 50 bp, Homo sapiens
atggtaattctctggacccttcctcgaaattaaacagagatcactttccg

SEQ ID NO: 282 - DNA, 1024 bp, Homo sapiens
tgccctcagtaaatgtttattgcatgaacacctcccagcttcgggcaggactgaaatctatccggttaactagtgaattcccagactctccgtctgcgtggcagggacatttaaacccccagcaccgtgattggctccagctgcaggggtgtgtctgtgtccgcggcgaacgggaagtgagcaggcgcgcgggctcggcgcgcgcaggcgcgactagggtgcagcgccaggtccggtgttggggtgtccgagttgccgccggagaggagtggcctcgcccgcttggtgagtctccaggagtgggacggagggagctggccgggatgaagtctgagactatgtcctgagaagaaagagtgtatcgtattggttgaaaagttggtggggtcgggcttaagcggaggagggggctctctggcccttactcggcagatgggcccggagagaggacgggaggtgccgggagaacatcgagggaccagtggaggaagggtagctggatggtaattctctggacccttcctcgaaattaaacagagatcactttccgcccctcacccttactgtgttgctgtagttgacattaatagactgcctgtatggtgaccacagtgatcagatagctctgagataatggcttgaggaaggactctgaggttcctggtattggatagcccttgctctctagaaaggttcagccttacctcgcggcattactgcacaaattagaggatcaggaaaagaatgaatttcacaattcgggattggagtggtggggggaaaaagtactgtaaagtgtagtttcatctcgtcctttttttcttctttaatcagtcaccacaatgttaggaaaggcagttgatggtaggaggaaacgtaaagacataaaagtgggagaggaaaaaaaagtcaagaagggagtatcattttgccttttgctatttgtcatctcctggaatggggtctgtattagtgcgttctcacactgctataaagaagtacccaaggccgggcttggtggcta

SEQ ID NO: 283 - DNA, 50 bp, Homo sapiens
gggctcgggctggagggcgctgggggcctcgagggtctctggtactggcg

SEQ ID NO: 284 - DNA, 1024 bp, Homo sapiens
gggaccaaactcccggccttcagctcttgccctccgggtctccgggctccgcacctgcgcccgcccccggcctcgcccctgacctgtgcccaggggctgggcgggccgaacagcggagaccggaggggcggggcccggccgccctgagaagctccgcgggcccggctgggcgagtgtctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggtgagtgtggtccggccgtggtgccgcccacgcagttgctgccccggcttgggagcgcgtcctgcccgccagcgggctcctctcgaacggggacatgaggagggggccccggggctcgggctggagggcgctgggggcctcgagggtctctggtactggcgccggggcacaatccagagccctgcgcgccgcccgggctgcggaggccccgatctgagcgcgccccccgccacactcggcgcccacccagccgacctggccttgggccggggctccacggggcctcccggtggggcgtggactggggtgggaagacgattggcatctggcgccttttctggcctcccccaactctagaattcctgagagaggggaggggacagccctccccgccctcaccctgccctggggctgctctctccgcaggaccaggcggtccagcgaaggagtcgactccagcgaaggtgagcgccacctcccccacgcagacacttccgtctgccccgggcctggccacggccgtcctgggctccagctgcagggacagaaagctccccggaggacgcgcagcgaagcccactgccaaatttgtggggcagcgttcccggtggggccggctggtgggctcgcggtag

SEQ ID NO: 285 - DNA, 50 bp, Homo sapiens
aggggcgtggcgttacagagcctctagcgctgggtgttggggacctgacg

SEQ ID NO: 286 - DNA, 1024 bp, Homo sapiens
gccagatcctcaggccacatctctctcctcccacgacctccgcggtcctccagaaccatagagagttgtacagagatcgccctgctctatgctctactctcctggggagcggggccagagaggccggaagtgctgcgagccctgggccacgctggccgtgctggcagtgggccgcctcgatccctctgcagtctttcccttgaggctccaagaccagcaggtgaggcctcgcggcgctgaaaccgtgaggcccggaccacaggtgcgggaggcggagactgcgggtggagattggcgccgcggaagccaatcattgccgagtctgagagatggacaaggccaggcgtggggagggcgtccagatgctagcctcgggggccggacgaacggaaggcgggggatggtggggacggagccaatagaatccggtgggggcgaggggcggagcgatgggacttgtggacctgtaaggggcggggcgagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtggtaggacaaggagatgcggggcccctgggaggctgggggctgttaggacgaagaggataggatggggcctgtgggaccagggtgtgggttagtggatttgggggccacggacgacttggggaaacagtccttggtcctccccaggtcccagtttccccatctgtgaaatggatgggtggttctaagagagggctaaggcagaggccagacactggcattcagcaggtagcccctgatgtgttttacgaggc

SEQ ID NO: 287 - DNA, 50 bp, Homo sapiens
ttcagctgcgatattatccccagcgagcctgtgaagggcttagggcgacg

SEQ ID NO: 288 - DNA, 1024 bp, Homo sapiens
ccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacggtacgaggcccgggctggcggggcgcgcgggtcgggccgcggggggcgtcggtggcgcggggccgggcctgggctgcgggggtcttgagggtggcggtggcgccggccggagccgggggacggatctcggaggtgtctgggcttgggaccgggatgggggacgcgggccgctgggggctcgggtggggtagcgggtgcgcggggcgcgggggcgctgtgcacagcgcattggcgtgatccgccttttcaagtttcctcttgctctttctctgctcttgcactcttagcgcttttcccctctcagtctaatgtaaataactgaaggtttgaaaagccagcttgatgttcggtttcagctgcgatattatccccagcgagcctgtgaagggcttagggcgacgcctgtgttcctcaaatacttcagtttgacctttcctggtttggaattccttgctttacattgggattacagtgaggagttattaataggctaattcattcatctcttcctccggagacctcttgcttcgtttatttctccctccctctcagtgttttttagccttttctgggttgcattttggctatttataaacatgtcttgtctccttcttaagaccgtaagcaccttggaagcaaagccctggctgtttaatctttgtttcccctgcagcacccagacctggaggtgcttgacaaatactgttttgaataagcgaaagctttcccagtgcatatgctgtgtgcttttttttttttctccccttttttggccttgcgtggtaagaataaacaacttgtactttgtatcagagttgaatattaatagatgtttaccagtccctaatcactctttcagatgtatgtattctcag

SEQ ID NO: 289 - DNA, 50 bp, Homo sapiens
cgagtgaatcagagaatgaatgagtggggaggaaaatcccagtgctgccc

SEQ ID NO: 290 - DNA, 1024 bp, Homo sapiens
aggaaaccgccgctcgcgctcctccagccgctgcctccgcctcctccccaggcgcggcgctccctcgccagagacgcagcgactgccagcagctcccgcgccgcgcgctcagtgactgactgactgactgactgactgactgactgactgactggcgggcggcggcgggagcgggggcggggcggccgcagcgccccgcggcggcggcggcggcggcggagccgagtgtgctcgcgtccagccgagacgcagaaggcggggttgagggccggactgccgactgtagggccgactcgcgcgggaccgcgcgccgcccccgcccgccgccaaccactcacttccggcgcaggccgccgcgcccgccgcccttccctagcccgcgccccgcgccggccctccgccctcccttcaggcgcccggccgcgcccggccgcactcaaccgcggctccgctcgtgcctcgcctttcctccgcaagtccctgtgagccgcctacaggaacgagtgaatcagagaatgaatgagtggggaggaaaatcccagtgctgccccaccccctgctcgcctttcataggaagccggcccagcagcctctgtcctagcgccctgggaggcacagcagcctccagcagttctgtcagggagctgtacgcatccacctttatacgctgtccgtgtattcagagactccagaaacgcatccggggttggctcggtcacttacaggaccattgtcgttgagatctgtgaggcccttctttaggaaatcccattttggccaaaaagtctctgcagtttcatggaatgtattgggaaacttaggaacgggacatttcgatgacctttactttttaaacttcgaaatctgttaatcctgcctccttaatttctgtccccccaccccatcggaattgtgtagtagtaaggtgtcggcatttttccttatcgctaagctcagctgctgcctctttagatgcaggcttgacttcggcagacttttagattttaagtatgtccttattttg

SEQ ID NO: 291 - DNA, 50 bp, Homo sapiens
aggtgcaagactgcgccagattcaaggacgagggctgcccgattatctcg

SEQ ID NO: 292 - DNA, 1024 bp, Homo sapiens
gagtggccaggagttgtctgcgtgtgccctgtgacggtgggatagagacagcgattggattgaggaacgggaggttccccgaggctgtttagagaggcgggagcgggagctggtcagggaggctggacagaccacccgagggagcggagcttgggcacgaaagccaaaactgggcggcgcggggcgggtggggaaggccggctgagaaagccgggattgcctcctggtgtcaaagctcggaactgcagcaggatcctgggggcggggcttgtgttcagcagcactcgccacgcgcccagccctcagccctcgtctcgccttctgctggctggcccggcgacgttgtgcgccagcgtacgcggggctctgagaacccggaagttacgttttaggcccgcgtcacgggggcgggagtcagctgagctgccggggcgaggttgggatcacctggcaccggctgaagggagcctgtgatttttttgtagcgggggcggggagtaaggtgcaagactgcgccagattcaaggacgagggctgcccgattatctcgctgcataaggcaagagcaagaggatcctcaggattttaaagaggaggcgacggctgcaggttcccaggatctgtcagaggctggggagttacagcttccattctggggcgacggggaccccgggggggtagcccttttgtaatccccaggccccggacaaagagcccagaggccgggcaccatggcgtccatcctggatgagtacgagaactcgctgtcccgctcggccgtcttgcagcccggctgccctagcgtgggcatcccccactcgggtaaggaagaggagggtgccgctgcccctttcggctctcctagcatttgcgtgggagcagcgaggagggcagctccaagagctcggggtcatcccctgggccgtgccttccgggtctaggcccctgattctcctcaggctctcttggcccccagctggtggatagtcgaagtttgaaagagcaacgggagctgccgcgtgat

SEQ ID NO: 293 - DNA, 50 bp, Homo sapiens
cgggacccaggaaggcagcagaagccagcaccaacagagtcagcatcctg

SEQ ID NO: 294 - DNA, 1024 bp, Homo sapiens
gtttagttcatactaagtgaataagaacaggctcaaagggcatgtgactgtgaccacactagccccagagagggcatgaccagctcttaaaaaccagcagaggaagcctcctgacccagtcacatggggaaccatgtggaggccgagatataaaggaagaggaggaaggagcatttcaaggaagaaacagtcccgcctaagagggtcaccctaaaaacaaggaagtaggcagtccagtcctgacctgctcggagttgaagcagtcggcgttggaagagcctgaacacccggcctaccacttgtccttccatctctgggccttcaggacagagcggactcccctctcccctaacacagacagactggtgacagtaagcctgagaaaggggctgcttcggtctccagccacaactctgtgaagccaagccacgcgctgtcttccagagagggaatagaagtttccatcctgtgcacccagtggttgagcaagaaggatgtgacgggacccaggaaggcagcagaagccagcaccaacagagtcagcatcctggcactgcagcgcagatctcagctcctcccaagagccccagggtgtggcgagagaaaaggtcatgagcaaacacctctggctgaaagtagccggaaaggcctggctacttatgggctaagggttttgaatctgggctgcagattgtgcagagagttaatttacaaccttagaacagtggacaatgcttgatagtgtcagactgtgggcactggaaaccggctggtctcaggatagggatcctatacctccaacacttggattgctgacctttcacttctcaacttggtcaacggaagtcaaaaaccccagcaaggccacctgctgaattctagaacttccaggacttcccgacctagagcacatggccaaacactttctgcagccaggatgtcactgccctcccctgattaagataaatagacttggcctaataattatccaaatagattaattcttccaacaaaagaaagagtt

SEQ ID NO: 295 - DNA, 50 bp, Homo sapiens
tgaggctgaacgtagccttctgtagaactccctgctctcttggtgtggcg

SEQ ID NO: 296 - DNA, 1024 bp, Homo sapiens
tttttagtggagagcttggagttagagtggggcaggggtaggagacagagttcacaaagtgaacatttaagagactttctgatgtggcaaatactatgaaggaaataaataggatgacaagaaagaaaggaactgttaggatggtttgagaagatgacaattaggctgaaattgcagggtgggaagacagcagtcatggtgagagctgtgcaagagctcgcgaggtgatgggcacatcaggtgctcagctgtgaggtgggagacaattttggcatgctcacgaacagaggatgcccgtgaggcaggtgcgtagtcagcaaaggacagagggctgggatgaagtggagaggtgcgtaggagacagacagtgcagagccgtctaaggagagcttaggagtggaaagatgctgaaaggctttacgcaggcagttagttttcatagccacttcctgatgttgtatattgctgcatgtggtctgtggctgaaagtttcccagccttgaggctgaacgtagccttctgtagaactccctgctctcttggtgtggcgcgccagcatactctagctatgagagtgctgatggctcttgggatttgggatggatcatgacctaaaaagggctcttttacactggaggaattgttctgtgaaatgttaagtcaaaaaattatttttaactaaaatattttataatttaatagaccaggtggttacagctattcaatttggtggaaaaacaatgccaagaacagatagttgcccagcaggagcagttccacaaccaaattcaagtaagttaccatttacattgattcctttttttatatacatatacatacgtacatatacacacacacacacacacatatatatatacacacacacatatatagaaatggagtctcactcttgttgcccaggttggagtgcagtggcttgatctcagctcactacaacctctgcctcctgggttcaagccattcttctacctcagcctcccgagtagctgagattacaggcacc

SEQ ID NO: 297 - DNA, 50 bp, Homo sapiens
aaaataaacactccagggtaaacacctggcttacttttaaacatcagacg

SEQ ID NO: 298 - DNA, 1024 bp, Homo sapiens
tgggcagccacactgcacgcaggctgggccgactgaggggctcagaggccaggctctgaggcccacgcagggcctagggtgggaagatggcaggtgggggcggcgacctgagcaccaggtgagtctttatctcccttcctttaacctttatctctggctatattgcagctttcatgcctttagttcagtttgtgcctaaggcttcactttaatccttctttgcaagaacataggtatgcgatgttatataatgaaatgaaagacaagtaatgaggaaatcagattttttaaacaggagcaggacagctgttggtgtgagttcaacttgccataacacacgtgactttcttgttttggatttactgctcagctgaccgggacactctaaacatagcagttgttggtggctgggattaactatttcctcatgatctgtgaaccctttcacccctcagccttcctctaccttcaaatatgtcatgtcaaaaaaggtgctttagaaaataaacactccagggtaaacacctggcttacttttaaacatcagacgctgtggtctcacctgtcctggcaaggggcctctgccggctgttcccatgactggctcagggtctgagttcttattccatcaaccttgatcaaaagaaggaaagggaagaaaaaggcccagggtgacaaacggctaaatattttcatttttacctcaatttcctgtcccaagatgggggatacctctgaccagaaaagagaaggaaatcctaacttttctctagtagtgagttgagaaataacattacttaatcttttaaattttttaatacaaaagaaatacactgtacattattgttcataaaatttaaaacagtggagaagtatattaaggaaaaagtcatctttgccactcagccattcttgtagcttctcttcccagtcctgtgaagagtcttgggcacagcttttcttatatttttctatgcatttatatatctaatgcattttttgtaaatacgtaatttatgttctt

SEQ ID NO: 299 - DNA, 50 bp, Homo sapiens
cgcagacctccgccctgagtgggtgggactaagaggcgcgaagaggtggc

SEQ ID NO: 300 - DNA, 1024 bp, Homo sapiens
cccggagtccaaaattcgcaccgaacaagatcctcctgagtcacagagtcacacgacccacaactgcaaaagcctgtcgacctcggaaccccattttcctagaagccttcccaagtccaatcccagccaccaggccacccacgcagacgcctaaatacaaacgctccacgccgtaagccaaatccaggcctcctagtcccaggccccaacaaccggcaccccaacgcgacctcgacttcaaaccgacaaaggataccagcaccacggcttcagctgcttcttcttcttgcgacccataactgtgttctaccggcaaagtaaaagggaggagaaaagaagcaggagaaacgaggccaaaaatccctcactttcccaacccaacggctaccaccacgtcccacaggaagcagacacaaaatggccgacggcctcgttccccgctccgcctcccgtcaagcactgcggtaggaggcggagccaagaaggggagggtcacatgacgcagacctccgccctgagtgggtgggactaagaggcgcgaagaggtggcagccatcttgtccgtttcagagtttttcgctttcgctggctgtgcttgcggagcactttgggtttcatttgtaaaggagccggagccccaggtacgctaaggggcatgcgaatggaaaacagaaaacaaaaaaacggaaaagattgccagtgcagttagggccgatcacaaataaagatagagacagcgcccaattttaattttgtttcaattgaacagtaaatgttgattatgtgcctattaaatgctaaaccaaataagttagtctctgctttgtaactcgcagattggtgacagacgagtacacaatgcagagttctcagtgcggcgttgagggaaatgcgaagtgctgtaggacctcagagagcgggagtcctagggcggctgtagtggtagtggtcgttgggttgtcaagtaaagttttgtttttctttgttttgttttatttttctgagaccaagtctcgctctgtct

SEQ ID NO: 301 - DNA, 50 bp, Homo sapiens
cgtgtgagccatacacaccccagctagtgacgttgggcttctgtggacac

SEQ ID NO: 302 - DNA, 1024 bp, Homo sapiens
tagagggaatgggaggggatgggaggacttggggacagcagtacaggcaacagacaagggggcctgctgtaaagggagcagataaatgggattggagccaaatgaagaaggggagtgtcaagagagtgctttacttttacaatggagaattagagtgcattgtgcactggtggggggatttgatctcttagggagagaacagtgttagggagggagaatgcaggatagctgggggagggtggggggcttggccccagcagagactcaggacacttgggaagttgagcttccctgggcttcccctcctctcctgtctgcaaggggtcagtgggctgagatttcagcacttaagcaaagcatttgctcttggccccagagaaaccgggctggctgtggtctcaggaaggaaggaggtgtccaggctcaggcctgggcctgggtttcagggagggcccacgtgggtcgccccttgaccctctctttcagcaaggaagtgatcctttctctacatgggcctcaccttggggaggacaatggtgtctttgaagttgtagtaactgaagtagagatcaaaaggcaatgcagatagactgacagatttcgcctgaagaggggaagcccgaccaggtaataaaggagtaagaggaaggatgttaaggacaattttaggaaacagataatgagtgaatattttttctctctctttcccaatttaaactgaagcaggagaaactgaagctagacataatgattaacttcccaagctggtgagcttcctgagctggttagtgagaacagcactaaggccaggttctcctccccagatgtttaagatgagacaggacaatgcctgctcagagacagggcctggctgaattggccctcaggattctctctgctctgaggtttctggaagaaggccagggcagaggtgtggtgatgtagctgctgggaggacagagctccgagtcacgtggcttgggcgggcctccccttcctggtgtccacagaagcccaacgtcac

SEQ ID NO: 303 - DNA, 50 bp, Homo sapiens
tgcgcagtcttctccgcttactttcaagaattcggagaatttggataccg

SEQ ID NO: 304 - DNA, 1024 bp, Homo sapiens
attttaaaggattaacagtggaaaaagaatatccctgttcctcttccttcccccaagtcctcaacatgtgaaaaatagagttgataagtaaggagatttaaggcagaacccgaggcctacggagcagttaccttctacggcaatttcaagggtggatggtgcgagcgccgctggggcagctggcgttctggttcttactccgtgggaaaatggccctgagcccgactggcttgaggcttagacaggtgaccccgcgaagcgggtgggcaggcgcggccgaggggcgggaggcgggcagcctccgtgattggccggcggagggggcggtgtagcgacccgaggagggaagaggactccaagcgccatggccgctgccgcccgagcccgggtcgcgtacttgctgaggcaactgcaacgcgcagcgtgagtgcggggccggcgggcgggcaggggaccgcagggtgcccacgcagccccctgggtgtgacccgctcagatcctgcgcagtcttctccgcttactttcaagaattcggagaatttggataccgccctgggctcccaccgcgcgccaggcggaacagcgaggtcacagagtgcgcgatgcagcctctcagggcgcagtgaggcagcctttactctgcttgtctaccgttaaagaaactgaggcccagagaggacctggtcccacatcgtagcaggcagtggagagcttggcacggtggccaagacaaattcatgtatgcaattgacacatatttattgggcatatattatgtgccaaaaactattctaggttctggggatacaaagatgaaaggctctggagcagtttgaggtctagtggggaatgggatgaggggacgaggctaaaaccggctatagcagactgggtgtagaagggaaggatggatgtgagaagtcgcagagtcacacttcctggcatgtacagggagtcagggtattcaatgtcatgacacgcctgcctcccagcagaaatgtgaggtacatcctggtcacctgat

SEQ ID NO: 305 - DNA, 50 bp, Homo sapiens
cgggggataatcagagcctcagaggcataggcacatacccttagactcag

SEQ ID NO: 306 - DNA, 1024 bp, Homo sapiens
aaagtggcacaactggggagtcagctgtgcctgcagtgtctggggatgctctgtgtccatccgcaagcattctacgtgacctccactctgtgcctgcaattggtgggttgtagaagaggtagtcacgaagggcccctgggagacccagagtcaagaggaagagaggcctaaaaaggagaaaagatagagaggggacagctggagaagagccacagacaggcaggagccagcaaagagagacagagagatgggggataactgaggagttctggggaggaggggagcagaacggcatctcccctgcactcccacgcccggcatgttgctggctcctcctgtcagctggagggtgctgggggggcgggggggaagggagctgcaaagcactttacctctcactccaaacctgcccaaggtgcagagcccccaaacagaccaacatcctgttctgtgcagagatgcatacatggatgcgtgggcccacatttaccaaaagaacacgggggataatcagagcctcagaggcataggcacatacccttagactcagtgcagaaggtccccaaaacttcccctcctctttctcactactcatccactgtcaatgaccctaggagttgaaaagtccttctccacttctacctttatctctcaatctgcagccatggggagactctgggagctacctaagaacagaggtgctgatggtagcagagtgtgaagctccagggttgggcaggagtggaggatggcgagacgagacggcagaagagggaagggacagctgcttgccctctccatgccaggtgccacgtgcaccaggtgggggggagtgggcgagtcacgaggctgtggcatggctgactcctgctctgctgtttaccagctgggaacgagagcaggaggaggtgccagggagcctcttgctgcagcctggcccctggccagttgcttgttgggtaaccaggagagtcaggcccagctaatcaaactctgggcccaggccatgcaggagaaaagcagc

SEQ ID NO: 307 - DNA, 50 bp, Homo sapiens
cgcatgttaaacatatgtaaatcctagaaaccgaggtagcttcctagacg

SEQ ID NO: 308 - DNA, 1024 bp, Homo sapiens
gaataagaaatactcgtttagaggaagaaacactgaaataacgagagaaaacatttcataaaaggcccctgaaagtgtgcaaagccaaagctcagacccttataagtggcatttgcagagggctgcacgttcacggcctgcagcacgagaagtcttgtccaagagcctcctggaagtcccaaaaggttccagtgtaacagttaccagagtctctcaaaagttctgccaagacctacacagcccaggtgtgaatgagacatgaaagccaggccacagtgcacacagcccagcaacgagcccaggctgttgcacaagaaaagctgaggacttggcatctgttctctgtgcccttcaaacacacacgagctgttgagctccttctgtgggcatcaaagcagagtgtggggctgagcgggcgcctgccaggtgtgtctgtggcaagcctcaaggccccaccattgtgtgtgctgtcagcaaagtgctcggcaggagggcgaatgcgcatgttaaacatatgtaaatcctagaaaccgaggtagcttcctagacgtgggaaggcaaatggccagaagagacagggaccagagaaaaggccctggtcttgctaaagggcggcaccttcaagaagccctcaccgagagctgtgggaacaagagctgccgggaacaagagctgcgggaagcggctcctacgaattggtggcaggaggcacaaaaacgaaatacctatttttggaatacggaaaaaacagacaaacaccaatggcatgcagagaaccagctggctgcaccagtgaggaaacatggctcccggctccccaacccgcagcgggtcaggtaaaacagataaacaccaatagaatgcagagaaccagctggctgcactagggagaaaatgtggctcccggctccccagcccgcagcgagtcggtaccttcaggatgtctgactcgtagctgttgttgttcagcacgccgtccagacacttgtcacccaggttgagctctgccgagatgaaggggcaa

SEQ ID NO: 309 - DNA, 50 bp, Homo sapiens
cggctgatgcccctggctgctgggtcgcccaccactctgtgaactcctca

SEQ ID NO: 310 - DNA, 1024 bp, Homo sapiens
gaatattagttattaggtaagagcattgtctgtaaaactctgaaaagtcttaaaagtgattcctaaaatttcacaagctcataaattctttagtctgcaattatgattcctgaaatattcttcgattcatgaaagactggactaggaaattctaaaaatcgacataaagcataaaaagccactctgaggtttatgaaatttacaatgttttgtcttcttttaattcattcgtacttttctctcaggatacaaagggcaaaactgtttgtgtagtaactcagaattgagtagttacacatccattaggtttcagaatcgttaaaattttatctggtttaggaaactgcttaccttggaagggcaaattgccatttctctccatctggggatcagggaagcaagggaagcccccctaaacatcacttccacgctcctatattatgctaaggaacttctggttgattcattaggcatttcagcagtgtttttggccggtactaggaactgtggagaggtatagaaagggagcaagtgcacagtcccggcccccaaagaggttacgatgcaaatagaagcaggctcagaactcggaacaaaagcagtgactgcataataatgcactgctgggggtgggggatggggatctgcacgcccggtttgtgacttcaggaaagcagtttccaggaggtgagagtttaagccaaacctgaaagaggttgatttgtaatgatttgcaggggggcactggaggcagccgccaggacttttcacttaggagatcagcatttgccctgatggaaactgggcgatcctgcagggactgacctctgagttatccaaaggccgacctggggaaagactgattttgaggttttaataggtaagtttggggacatcattgatgaaggtgggcagggaaggaggcttttttcttttcttttttttaatgttacagtaaaaagcttagattcgatgagacgggttaaaaaacaaataggaaaatttaaggagaagaatgactatg

SEQ ID NO: 311 - DNA, 50 bp, Homo sapiens
cgcattttgcaggcctcgtcgtgtttttcaaagagccacaggccgccaca

SEQ ID NO: 312 - DNA, 1024 bp, Homo sapiens
cgaaaatctagccccgtctccaaagcggcggggaggctcagcacgcgttcgttccccagagtctagggaggtgtctggggcgataattcggaatgattgtggcttgatctttcccgttgccctcccaactgtagccggcccctaggtctgctcgacagacttaggaggcgggagaggaaggggtgatttgcagtgaagcccaggagaggttgggccacgcggctgggagtgggagcggggacccggagccgggcgggcaggcagtgccttggcgaagctgtccgcggtccctgcggcgcagccggagcgcacgggcccaagaagaagtggggttggacccgcagaggccactttccacccgcatggagaaagaaaattctctcctctgaaagcgagggcccttagctttgcagccactgctgtttttcttttgccaccgacgcgcgtaccgtttcacgatgcaggaccgtggttacatgcgtaaaggaaaaaaagaaaaacgcattttgcaggcctcgtcgtgtttttcaaagagccacaggccgccacaacgaagaacgacgccgcgaggcctgcaagatcctgaaacttgttttgaggggagagcagagaggaaaggggttgttggccccaggctacttagggtccctaggagactcccttccgcctgtccccggtttggcacaggggccaccgaggctgggaccaaagccgcgcagggctgggagcagcaaaggccgccggccgggcgtggacgacgcgcaaaatcccgtgtggggtggaggctcttgggtcagaataatgtgcgggacgagggaggtgagtaacctctttggggcggctcccagtgcggcgtcaccggccctgagaccccgcggcccccagcccggggttgcagaagtcacaggcccgaagcagcaagagctggggaagcccggccgcggccagcggggaggaggagcgaaggggttgcgccccagcgtcagggagctacgacccgagagagggcggcaagggcgccttc

SEQ ID NO: 313 - DNA, 50 bp, Homo sapiens
cggctggactgaatctctatcaggtctgacaagctgcagctagtgagccc

SEQ ID NO: 314 - DNA, 1024 bp, Homo sapiens
ccatacctgctgtgacggtccactgaggcctgtggactatcacctcatcccccttctcgggatggtcttattaggccgccgtgctaccattttttgttttttgttttttttgttttgttttggttttctttttttgagacaggatctcatgctgttgcccaggctggagtccagcggcacaatctcagctcgctgcaacctctccctcctgggctcaattgattctcctgccttagcctcctgagtagctgggactacaggcatgtgtcaccatgcctggttaattttttatgttttattttttgtggagaaatattgcctatattgcccaggctggtcttgaactccggggctcaagcgatcctcccacctcagcctcccaaagtggtgcaataacaaggcgtgagccatcgtgctcggcccgtgctactgttctgctcctagctcccctcatgtgcattccccacccgcacctccagacgtacccctctaaacccagcccttgagcgtctgctgcgcccacaggatgcagctcagactcccggagcgtcccactcccacggctgatgcccctggctgctgggtcgcccaccactctgtgaactcctcactgggctgcagaaccccgggcaccttctgaatcctgtaaagctctgaaacccctgtgcctggccaactcccctctctcagctcagaccgtccttctttcggcctccaagaccctgctgcaaccgtgcctacggagcccccgcgacagcacgcgaagaacgagggttcttcaggactggggctctctgccggccctggccaaagcccccggcctctgacaaacccactgctgccacaggacagcctggctgtctccgctgggaagtctgaaggacaagctcctgctcagcctctaccgcaaggtgtaactccgtaaacaagcgccaagcacccagcggagccggggtgggaagagccgcggaggccgcagccagggggcaggattgcgggcgggcgggtgcggggtggggggctg

SEQ ID NO: 315 - DNA, 50 bp, Homo sapiens
cggctttcaccaactgggcccagccagcctctggaggcccctgcccggcc

SEQ ID NO: 316 - DNA, 1024 bp, Homo sapiens
ccccggggaagagggagcagggagctggcagccgccccagcccactccttacaaggcctgagcccggccccaggcccgcccccggcccgcccgcaggaggccccaggccctccccctgtcaagagctgccgccagcccggggccggaccagtccgggggcatcgcgatgctgctgcgcctgttgctggcctgggcggccgcagggcccacactgggccaggacccctgggctgctgagccccgtgccgcctgcggccccagcagctgctacgctctcttcccacggcgccgcaccttcctggaggcctggcgggcctgccgcgagctggggggcgacctggccactcctcggacccccgaggaggcccagcgtgtggacagcctggtgggtgcgggcccagccagccggctgctgtggatcgggctgcagcggcaggcccggcaatgccagctgcagcgcccactgcgcggcttcacgtggaccacaggggaccaggacacggctttcaccaactgggcccagccagcctctggaggcccctgcccggcccagcgctgtgtggccctggaggcaagtggcgagcaccgctggctggagggctcgtgcacgctggctgtcgacggctacctgtgccagtttggcttcgagggcgcctgcccggcgctgcaagatgaggcgggccaggccggcccagccgtgtataccacgcccttccacctggtctccacagagtttgagtggctgcccttcggctctgtggccgctgtgcagtgccaggctggcaggggagcctctctgctctgcgtgaagcagcctgagggaggtgtgggctggtcacgggctgggcccctgtgcctggggactggctgcagccctgacaacgggggctgcgaacacgaatgtgtggaggaggtggatggtcacgtgtcctgccgctgcactgagggcttccggctggcagcagacgggcgcagttgcgaggacccctgtgcccaggctccgtgcgagcagcagtgtgagccc

SEQ ID NO: 317 - DNA, 50 bp, Homo sapiens
cacagccttttcctgcaagcctttagatcttaaatactctcgaacttgcg

SEQ ID NO: 318 - DNA, 1024 bp, Homo sapiens
ccttgtgctcttctgatgatttcgctatcagttaacacttcatagcctggttcagtactgtctacttcaagccatttttcaaggttctcagtagtcacattttccaatcctttggtgtgttgtaaaatggcagccacagtagccacagaaatatcttcaacatcaaagtccaggctctctttctcctctaccatagggagaatcttcttccatgctctgctaatggtaactggttttactaagttccatgccattgctatttcataaagtgcatccaacagagttagcttcttccagaatgatttcaggtcattaccttcttccaagttgttctggagaagacctgcacgataatttctcttcatcgttgctatgactccctgatctgaaggctgaatcaatgaggccacattaggtggtaaatatttagcaaatatttggccatcatctgaccttaggacattttcatttggatgtgttggtgaattatccaacaagagcacagccttttcctgcaagcctttagatcttaaatactctcgaacttgcggcacaaaaattttatcaaaccattgtcggaaaatggaaagatccatccatgcacctttttggctgaaataagagactggcaggtttaaggtgtcagttgatttaaaggagcgaggtttctttgctttccccacaacacaaagtttaagtttgtgtaaacctgttgcattggcacaacacatgattgtgactctttcttcaattgatttgtgcccagggacagtgcatttacctttgattactgaaatcctagaaggcaagcacttccaaaagagtccagtttcatctgcattgtagatttgttcaggctgtaaattctctcgttcaataaaatctcgaaagttattacaaaaatcttccaccgcagtctcatctccatttaatctttcatttctaatgttaatctctctaatgctgtgccgctgcttaaaacgagttagccaaccggcagaggggttaaaatcaccatccattc

SEQ ID NO: 319 - DNA, 50 bp, Homo sapiens
tggcaagcctcaaggccccaccattgtgtgtgctgtcagcaaagtgctcg

SEQ ID NO: 320 - DNA, 1024 bp, Homo sapiens
acgaggctctcggtcaacatgtttttccatgtcaaacctctggttgccaggtaattctgtgacgcaaaaaaagagaggaataagaaatactcgtttagaggaagaaacactgaaataacgagagaaaacatttcataaaaggcccctgaaagtgtgcaaagccaaagctcagacccttataagtggcatttgcagagggctgcacgttcacggcctgcagcacgagaagtcttgtccaagagcctcctggaagtcccaaaaggttccagtgtaacagttaccagagtctctcaaaagttctgccaagacctacacagcccaggtgtgaatgagacatgaaagccaggccacagtgcacacagcccagcaacgagcccaggctgttgcacaagaaaagctgaggacttggcatctgttctctgtgcccttcaaacacacacgagctgttgagctccttctgtgggcatcaaagcagagtgtggggctgagcgggcgcctgccaggtgtgtctgtggcaagcctcaaggccccaccattgtgtgtgctgtcagcaaagtgctcggcaggagggcgaatgcgcatgttaaacatatgtaaatcctagaaaccgaggtagcttcctagacgtgggaaggcaaatggccagaagagacagggaccagagaaaaggccctggtcttgctaaagggcggcaccttcaagaagccctcaccgagagctgtgggaacaagagctgccgggaacaagagctgcgggaagcggctcctacgaattggtggcaggaggcacaaaaacgaaatacctatttttggaatacggaaaaaacagacaaacaccaatggcatgcagagaaccagctggctgcaccagtgaggaaacatggctcccggctccccaacccgcagcgggtcaggtaaaacagataaacaccaatagaatgcagagaaccagctggctgcactagggagaaaatgtggctcccggctccccagcccgcagcgagtcggtaccttcaggatgtctg

SEQ ID NO: 321 - DNA, 50 bp, Homo sapiens
cgctcacccttggcggggagctctgagctttatgtttattaccatgttcg

SEQ ID NO: 322 - DNA, 1024 bp, Homo sapiens
aatacaaaaattagctgggcgtggtggcgcacgcctgtagtccccagctgctggggaggctgaggcaggagaatcgcttgaacctgggaggcagaggttgcagtgagccgagaatacgccactgcactccaacctgggcgacagagcgagactccgtcacacacacacacacacacacacaccccggtgtctttgatcatgccacacacacacacacacacaccccggtgtctttgatcatgccacacacacacacacacacacacataccctggtgtctttgatcatgacacacacacacacacacacccaccccggtgtctttgatcatcacacacacacacacacacacacacacacatcccggtgtctttgatcatgccgttgaacccccgaaggaacggcagccccgcgtgggtcaccaggcggcctatggcagggcccccatcagaacccatgcccatctgactggccggcccgtgtacttctccgtctggaagcgctcacccttggcggggagctctgagctttatgtttattaccatgttcgctgccccccaagctcctcccaggtgcttcacactgtacagtccacagagcagcgtgccatctgtcatttctcctttccagctgctctgtgaggtagatgagggatcatctaatctgtgcaccaaatccagctctccacctgcttttgtaaataaagttttcttggaacacagccatgcccaatcctttacagagggtgaaaacagactgcctagggttaaagccgggctccaccccttactagctgtgtgataaaatgagttggtgtatatgtaacctgtgcctcacggtttgtgccgcctagccattagctattattattaaagtctgttctgtttctgagcccccccccccaattttggctgctcagttgtttgtatgtaaatagtgcaatgtgacctcagccaaagccagaatgtgggacattctacagggcaaatgacgtggtttatccaacaaatcaatggcataaaca

SEQ ID NO: 323 - DNA, 50 bp, Homo sapiens
cgctgtcccagtgcagagcgtctgacctcagaggcagacacactgtccca

SEQ ID NO: 324 - DNA, 1024 bp, Homo sapiens
catgcggtaagcatggcaaagggggctcagggggcaccgccagcctgccctgctctgacgctggacttgccactcacctgctgtggggcctcaggcaaatcactgaactgtccagcctggatgacggcagcacctcacttgccttgctgctgggagtgttgtgaatagagtaggttagactgtgggcagggcttggtgaatggtagctgtgattatcatcatggctgcactggggacacccccaggaggcctgagtggcacaggtctcttgctcactgtatgtcccctgtggactcccttccaggctgtgcagtgagtggcagcagtgacccttgggaagtctcatggctacggcagcaggtgacaggtgtgacaacagggaagagggatgtggtgacagaggttggggttcccctctcccacagtcagtttcccacaaagggcggtgtctgccagcaagcccctccaatgagccccaagcttggtttccctccactccacgctgtcccagtgcagagcgtctgacctcagaggcagacacactgtcccagaggtggtctatgaatggagtccccgtgccctccccacacacagggaacatccaaatgccatcatggaagggtggccacctccccaggcttggtgggcctggggccgatagtgtgatacatttgaccccctcccagccctggatgcagacaccaagagcagagagacctggcagtagtcatgcagcagcgcaccaccccacatcctcagcacaatccaaagcagcccctcatccccaccgtgaccaccacagcctgaatccaggcgccacctgtttctgacctgaactccctcacagcccccgcctgcactccctccctccaacatcacctgcccttcagtcttccagaaagcagctagagggctctgtctgtccaactgcagaacaggccctgcctcctccctgccccgttggacagctcacacccttcaccaggcctgacagcgctcttgccactccaacaccctgggtccc

SEQ ID NO: 325 - DNA, 50 bp, Homo sapiens
atattgctgagatgtccaaatgactacataaattatgatccacctacacg

SEQ ID NO: 326 - DNA, 1024 bp, Homo sapiens
ccatcacagcttgacctccctggctcaaggtatcctcccacctcagtctcccaagtagctgagactacatatacacaccactacacctggctagttttattttattttatttatttttatttttatggagacagggccaccatgcctggctactttaattttttttttttttttttttttttggtagatacagggtctcactctgttgctcaggctggtctccagctcctgggctcaagtgatcctaccatcttggcctctcaaagtgctgggattacaggtgtgagatcttgatttttacttatgaacacatgcaagcactctgtatgtgttgggtggtgtacactctcgggacagggaagttagagtttcaattgtggccatggcttctttactctttctgtgatcttgagcagtcccacaactcttagaacttaattcattatagaagtgttggagaatttctgtgagataatcaggcataaatttttaaagcattaatattgctgagatgtccaaatgactacataaattatgatccacctacacgctaaactgctatgtagccattaaaaagaatgacgctgctctaaatatactaatatgaaacagtttccaagatatcctgagtgaagaaaagacagtatagaacaatgtatatagtatgctaccatttttgtatgtgtgcatgccttcacatatgtgtgcttttaagggatataggcatatttaagctcgtaaattcatagaccatctttgtaaaggtacacaaagaactggcaatagtggttgccttcagagaagagaacttgaagagaacctccctactggaggcagggatggtggaaggggtgggggatggagagagtggagattgagcttttgaattctgttccatgtgcatatattataaattcaaaaaaagatatagtttattttttaagaacctggaattaagtcctatctatgaaagctgaagagatcaaagtgagaggtaatttaatttgaagcccaggtacagcag

SEQ ID NO: 327 - DNA, 50 bp, Homo sapiens
tggactgtgcttttacgaccctacagggtatcaagatactgtgcagctcg

SEQ ID NO: 328 - DNA, 1024 bp, Homo sapiens
agagagagagaaacggagagatgaaatttatgttacttaagatcaagtttcacataatgccagttatattagcatatactggcaggattatctttccccacctacaaatagtctaatgacctcacagtcacagaaatcacagagaactaagctgaagagagaacactcgtccctgcttcccatcttagagcagctgaataatttcctgagaattctattcctgaagctaggaagaaaagtttatttatacatacacgcaacctgcaagtctccagtttctattcttccttcctctttgacccttcccctcccccactttgcaccagagaagtcagactccgggagtgctttaacagtttgaaggctaatctgaaagaggaagaagaatctgtatatctgtatatattggctagcaaatgtgccctgctctctcccctcttaaaaatagcagcaacccatctttgcaaagaagcttgcctatagagcaggcactctgtgaatggactgtgcttttacgaccctacagggtatcaagatactgtgcagctcgccaacaaggattaattgcaaggactggtagatcgaatttactgaagacttggagcttgcttctgagaacaaacgcaaaaggacagtaaactgtggaccttgaagttagcaggtaaggagactcagtattcagtactaagaccagaacagtatgtagtaaaatgttgctgatggtaaattttagcaaattcccaggagtttggggataagttatctgccttgcctgctttaagtttgggtgctagtatgaattctttctgctttatttcttagccagaaatctgataatatgatcagtctgtcaacaaatattgctcagtgcttctgctagggctcaacgtggcaaaatacagaggagacacactccgcaaacctcctgtgcctttgtaatttaagccagaaatgtaagatacattttcaaatccccattttgagggttcagtggagtttctctaatgtagtgacattttccttc

SEQ ID NO: 329 - DNA, 50 bp, Homo sapiens
gcagaaaacaccaaatcaaccataggtccaagaacaattgtctctggacg

SEQ ID NO: 330 - DNA, 1024 bp, Homo sapiens
aaccacaggattttggtgatgttctatttcttgactttggtgacggttacagtatttgcttaattattatttcattatttacatgttttgtgcacttttccaaaccttttaattgttaagaatatatggtaccatgtatttaagaatacatggtaccatataataagaatatatatttaagaatatatattattctttaagaatatatggtaccataatgtcctgaatgatacctatgagagcagtcatttgactttggcaaaaaaatgaggtttctcatggagtcaatttatgcagcagacagaaaaaaaaatcctttgaaagacaaatacattgtgtgcttcctgccaataacgatgtaatacttcctcgttttagttaatgaaaaataacacatactttcaaagttctgtagactctaaaaagaaagaaaacactcaaatgagtcacctatttccacattcgaggctgagaagctatataaatttctgcagtcactagcagaaaacaccaaatcaaccataggtccaagaacaattgtctctggacggcagctatgcgactcaccgtgctgtgtgctgtgtgcctgctgcctggcagcctggccctgccgctgcctcaggaggcgggaggcatgagtgagctacagtgggaacaggctcaggtatgtcacagcccacttacttagggttccattcttttgccatctgcattaagaaatgtgtttttcaattatttcccttcccatgttagcattgcagtggaattttctttggggtggttcttcggattataaaagcaatatatgttttcatcaagtagccattaaaagcaggtttcagaatctgctcaaatcgggcttgagttccaaccctccactcactatgtagatagactcaggaaggtcatcaaacttctctaagcttcaggtttccaatttggaagttggagataagaatggtatcaaccaaatgagggtgttgtgaagcattcaacacaatacctgaaacattgtttaaattaa

SEQ ID NO: 331 - DNA, 50 bp, Homo sapiens
cgcccggcctaacctctgagtgccagacctggcactgctgcccacagggc

SEQ ID NO: 332 - DNA, 1024 bp, Homo sapiens
actgggtcgcggcgctcgcgggccgtccccgcgctgggaccgggagagcgagacccggtcggaccggcggcgcgggtggaggcgcgggcagcccgcgaggcgcgtccgagggtccgccgagccgtcggtgcgtccgagcgcccccgagtcctgagctgcgaggcgcggaccgacggggatgagtccgggcgggaggggccgcgtgcactcaccgcggggcactgcgctcggcgtccgtccgtccgtccgcccggccgtcggcgcgtcgagagcccgggcggcccctggctgtgtgcgcgcggggcggggcggaggcgcgagaggcgggaccagccggcccccggccccctcccctgactccgcctccgcctccggggcggggtctcggccgcccgccggagagggggccgggccggcgccgctcgctcagagcccagactcgctgacccggctcctagaggccgcccggcgcgctcgctgcggagcccgcaccctccctgcgcccggcctaacctctgagtgccagacctggcactgctgcccacagggcagggccaggggttggggtccggccacctcagccagcctgagcctcagtgatcacccctggaagatgggcccagcagccttgggcacattgtgagggcctgaggggcccggctacaaaactgcccagaggccaggccctgcctcccacccgccttgcttcctaccctgggggcctgcctgcagccccactgctgctgcatgtgcctgggcagacggtactgagcccccagctttggaacaggttcagtttgtccttttcctcagcccagctctgatgcctgtgaccactgtgtgacccccggggtgtctcttcccccagcccacaccgatccctttctgggtctctttcggggtctccatctctgatctaatgtcatctctctgtctcccttggtttgtccctcttggtctctgcatctccctctgactttatctcttggtctctgtgtctctctgagtctctcccatccctgtc

SEQ ID NO: 333 - DNA, 50 bp, Homo sapiens
cagggggctgtgcgggatgcggcaggtagcggtgggagcacctactctcg

SEQ ID NO: 334 - DNA, 1024 bp, Homo sapiens
cggggctgcctgggctgggcgccggcgccggcgcggtgtggccgcggtcgtccctggttactgggctccgcggcacatgctcgctgctgcctcccgcctgccgccgcccctgcgctccccgcctcccgcctcccccctcccgcccgcacccgcgcgccaggggtggacccggagccgccactcagcgcccggcgccacctcccgccccgcacccgcctggccgcggcctccgccagctggaccccggcctcgccagccagccggaggggcgtcccctcggctcaacgcggccccagggcggggcagccacccccgccaccccctccccgaatccagccctggcgctccggcccccgccgcggcggggagggcccggaagatcggatgtgaatgaggccaggtcccggcccggagacattcattcattcgacacggattcatggggtgccggggacacggcggcccacgggacaggagtgccccagccctcgcagggcgggcagggggctgtgcgggatgcggcaggtagcggtgggagcacctactctcggcctgggggcaggagacctccaaacccagggtcaggaagggaggtggatggagaagcgttctggcccaggcaacctggagaggcggggaggcctgcatgcccgagggagagttccccggcttgcgggcttgcgcacggctgcaggcacaggggacctgggagaagggcagggcccacggggcaggccaggagaggcccctcgccgaggagctgggcccctgcccaccagcgcccatgaaaggacttcagcagagagtgatgggtcagagctgctggagtgacaggtcagagctgctcagagctgtttctctgagccgaggctggggtgacaggctccacctgaatggacagaggccagtggattcgcgtaggggggtgtggttcaggtggtaggtccagcatggccttcccggtccacctcatccaacatatcatcatatcttgagaactctcctatccttttcggctttagtt

SEQ ID NO: 335 - DNA, 50 bp, Homo sapiens
cgggtgacaccacccggttaggaaatcccagctcccaagagggtataaat

SEQ ID NO: 336 - DNA, 1024 bp, Homo sapiens
ttcgggctggttagggggtttaggagacattggttttgtacagacatgacttgatgctggattcccactttcagaagacaaactattcagttctgcaaactccacaatctagaataaggaattagataaccaaccccctccttcacttaacagttaaaaatcatacaggactctgaaaacaaaacaaaacaaaaacttaacctttcttagatcctaaaagcgttccttggatggaaaaccaactcttccactggctaaagatcaaaagcatctttttctctttaatggggccacagttgggcaaaacgcccatcactttaaaaccacctctcggctggaagtacgtaatttttagcgagtcacagaaaaatagggaaacttatgcggcgtttccttggccacttccccatctgggtgatcatgtactcagacccagcactgcagcctgggggtgctccccgtgaggaggaaaaggtgtgtccgctgccacccagtgtgagcgggtgacaccacccggttaggaaatcccagctcccaagagggtataaatccctgctttactgctgagctcctgctggaggtgaaagtctggcctggcagccttccccaggtgagcagcaacaaggtgagagaatgcagagctgcaggtaagaggctttggagagagagagagaaagagagagagggagagagagagagaaagagagagagagagagagagagggaggcagagagagagggaaaggcaaagagaggcagagagagaggcaggggggaaggcagagagaagagagagagatggagagacaggcagagagacagaaagaggcagagaaacagagacagaaagaggcagagagacaggcagaggcagagagacagagagagacagaggcagagagacagagacagagagagacagagaaagacagagacagagagaggcagggagacagagagagacagagaaagacagagacagaggcagagagacagagacagagagacaaagaaagacagagac

SEQ ID NO: 337 - DNA, 50 bp, Homo sapiens
cgcagctgcctttcagttagctcttgcccgggagtgcatcaagatgagag

SEQ ID NO: 338 - DNA, 1024 bp, Homo sapiens
ctgcttcccgcgtttccctggctccgcccccaggcctttctattggtcaacgtcagagccggggggcgagcccagcgctcctccccgcaaatgatcccgccccaggcaagtttggttcttgggggctagacaagtttcttccccggtggggcggctgaacactcttcccaagtacctgctttgggtccaagtttcctacctatgtctctagtctgtagggatttcttgatttctaactcactattttcaccaatcctggggaaaatatgtatcgacctaaggttaaattccacctggcccaggagcctcctttggaaaccaggaagccgggaatctcgttgcaaaggaatcctgggcctcagaggagtcgttgcctctgcctcatagcataccccgacactgtctctgttttgggatgcagggttctgtttctgtctttttgagaagttcctggtttaattcactctcccatgataaactgttgtgtctggtatgtgttacgcagctgcctttcagttagctcttgcccgggagtgcatcaagatgagagtgacccagtgaaaccagaaactgtcattgagtagcaggatgggaaagcaatgtctagggaccaggatccctttgtcagtttttcctttttcctctcctccggcccctcccaggccttctctgagggagaagaggaagggctatgcaaatgagcacccttttcttatataggggcctatcccagtccccccagtgcctttggttgctggagggaagaacacaatggatctggtgctaaaaagatgccttcttcatttggctgtgataggtgctttgctggctgtgggggctacaaaaggtatgtgtggatatgtggacatgagcaggtgtgaacttggggatgaattccccctgctctggtttctgtcctcctaatgggagatagcggcaatatttcaggcgtctcccactcatttgatttagtgaggatgtgggcacctgggctccctccctacatggagatttgggattttgc

SEQ ID NO: 339 - DNA, 50 bp, Homo sapiens
cggggtaatcctcggtccggccccatacaggacagaaataaaatcgccat

SEQ ID NO: 340 - DNA, 1024 bp, Homo sapiens
tggccctgggggtgtctgtaaagcctgtgaccgtccaccaggtggagaccaggctggccaggggagggagaggaagtgaccactggccctggcactggctggccggctccagcaggcccgaaggggagggaggagcctgggtgcaccagactctctcaataagcagcacccagacacttaacagatggaaagcggtggcttggaactcacttccaacgaaacaatagcacatgctccggctggctttgacacttgcttccaaaggcgacctgcacccagggccaggaccacggcatctgagcctcctcccccagccgccaaccccattcccaatggaggagcccaggagaactgggggcggccaaggcagcccttccctgctccgcagatccagaggatgcccacagcccccttcccctcccgcctttcccacactccctgtagcaattcacacaagcggggaggggacgaaactgctgaatccagcagatagcttgtggcggggtaatcctcggtccggccccatacaggacagaaataaaatcgccatttcagctccgggcgcagctggaggaggctgacgccccctagttaggggaaggctgtgggtgaccgagaaggaacttttcccgttttctattcaaatgaaatgagggtggcggtcgcagcagggagagaggagcgaggggagttttcccggcggggctggggggtccacagcggcgcggccacgctcagcccagcgctggcttaggagggacgggctgcgtggggaggcgacggctccgggccgaaggggtcgctcagggctctgcacagctgtccagggggcatcgggagataggcagccgaccgggggctggagtcaagggaagaagaaagagggggaagggaggtgcagggagtgaagaggaggggagagaggagagacgggggagggaggggggaggggggagggggaggggcgggcgggcggccgggaggaggagcgcgcgagccggagtcggagcccgagcccgagcgc

SEQ ID NO: 341 - DNA, 50 bp, Homo sapiens
cgggggtgaccaccggaccaccctgcagccatccaaatgcacacacacag

SEQ ID NO: 342 - DNA, 1024 bp, Homo sapiens
tcctggctgctgagggggctgtcagagggcaggagtggaagccaggagaccatctggagccattgccctcactgtccctgtgacgtcaggcccctcacccctctaaacctgtttattcacacatatgtgtgactgtgagaatcaaatttggaatgagcagaaatgcactttgcaaagctgaaaagtacgcataaatgcagggattcccgccttgctagaagcggagagtcctttggaaatctgctgggttagacctctctggggttcttggttgggacagtgctgggcctgagtccctaactgaacacctcatatccgagagagccccctttccctgcctagggttataggagagggctcaggggctggggaggggggcacctggctgaggctccgagtcttgagggggaagatgggaaagaagggtccccttcctggcttctgactccccctggagcaatggttctcttgtgttgcagggagggcgacacctttgagcacgggggtgaccaccggaccaccctgcagccatccaaatgcacacacacagctcctttcatcccgtgtcagggagttctctgaaattttctgaaactcattcacgaactctggcttaaaggcctctgagctagaaaggggaactgaaaggggacacctacctttttaccccaccttttttgtctggtctttctagcattaaccccctagacacacctaagggctgatgccggggggaacctgtcttgattgctctgggccacatcgagggcaccttcctgatacttttgttatctgccactggggacccggttgttgaagggggacttaagattttctcgaaggaggggtcactgtgagggcctttcctgcctgctaggggcttcagtttgggggcccccactcccgacctccggggaagggaggggtccccatctcccccgggcctctcgggtcttggggtctccccgggaggccggaggttgggaaccgggcgccggcgaaccgatcaggccccgcccgcgaa

SEQ ID NO: 343 - DNA, 50 bp, Homo sapiens
cggggaagtaaagaattgtcactccataaacaagggccagggtaagaaca

SEQ ID NO: 344 - DNA, 1024 bp, Homo sapiens
caactccacctaacccacatgtggtgtctgtgcgctggcgcgacccaccctcaccccatgacccacccttgccccacgacccacctgtatcatgtacagctgggcgatgcggtactcctccacggtcattggcagaggaatccgatattcctttataatcatcttggagtccaagccttcccgtcgatggggaactgcaagttgggacttctaggcaaggttccttaaataaccatgacaaaattcaccaaggacccctgggagacagagaggacagaacagaacagtcactttctgcaaaggctggtgaataccatagcacagaggaaaggcccggtctacacctgaggctggaattgtggcctctgatcaggcatgatccaacggtgcaactttgagcaggttctctcctttccaacctttatttttcttgtttgctaacagctaccaaaaggacaagtgagaggctatgtgtaagctctctgatcaacaaacagccacggggaagtaaagaattgtcactccataaacaagggccagggtaagaacaccgtgctcttgttttactcacaatcctaacaaggtacagcatctatttccccggtactgacacagtgagtaatgatagctggtcatggaaaagcaggcagatcaaataaaactaagcagcacagacatgagacattcacaagtcagcagtctgagccatgccattaggggcagatgacatcactacatcccaagggggagactctgagtgatttaacgtttggtttcagttcaatccaataagaaacatttattggcatctattttattccttccattgggctatgtctgggaagtagatgagacaagataagcagagagtgtgctcatagccacctctatttaagtgacaaagaatatatttgatgaagatttgtccctaagcaatcacatttttttttaactgggccgggcacagtggctcacacttgtaatcccagcactttgggaggccaaggtaggcagatcacttgag

SEQ ID NO: 345 - DNA, 50 bp, Homo sapiens
cgaacactaaacactaagatctacttaggaaaagtcatgggaaggggagc

SEQ ID NO: 346 - DNA, 1024 bp, Homo sapiens
atttgttaaatactgtaatagtcaatgctcaacacatcattattctctcatgccctcagtgaagtgatcctcaagaaggtgaatgtagacaaaattgtagaaaacgttgttctaagtctttcccgtgctttctaataatagaaaagaatagtctcttagatatgtctttgttttccctgctacattattaatactccttgttttttctttcctaccctgtactatatttcaattacgttatagtctaacaaagagaacagggtggttattttcatatggagattatgactgaataattcacttctaactgtattcaagacattggctttgttctccaaatacttctgaattgaacctttacgattatataacctttcctcaactgttcggaaagtataaaacattccacaacgacccctaagtaactgtgcccagcaacaccaactggtcagagagtgggaaggctgccctaacaattgaagtcttttccctccattcaacgaacactaaacactaagatctacttaggaaaagtcatgggaaggggagcggtgggcggtacaaaggagattcggtccctgacctaaagagcgtggtgctgagacgagacttggtcgaggagaaagccccagctttcggcgtcagcagggagacaccaaaaaggctgtgcctcggtttcctcacctgctgaggagggatacacccccaccagcacgctcgcagtctgcaggcatgaaaaccggcctaaagcgctgcagagtggctgattttaaaagggggatggctccgtttctcctccagagtcagggccccggacagcgcgcagagcagaggccagcccgagtcaccgggcgcggtccccgcatccgtgtgggcgcctcttagctcccgcccagagagcggccgggcggccttgccctccgcagcagcagcccggacgcccggccaggcccaccccgcgcacccacagcccacgggcccaggcgccccgcccaccctgtgccggcccggcttgtctcggtag

SEQ ID NO: 347 - DNA, 50 bp, Homo sapiens
cgaggtgcgatgggattagtagttttatagccttccagtgttccttaaga

SEQ ID NO: 348 - DNA, 1024 bp, Homo sapiens
actccctccttctcccagaggaaccccgcccccttccccctccttcctccaccacctccactttccaggacgaacgcacgcagggctcgacgggagttgtagtcctgcggccactgatgctacgggggaacaataggacgctggggacagcgggaactacaaacaggacggcggagggcgtgcccagccgggagccgaggatgccgggagttagagtcccgttgccccgaggctcccagttgcagaacatcgagaaggagagggaacgatgactacaaacaagatggccttctcccccgacccgacctccttcccaggcactcacacgccctcctgtccacaaccctccgcgtgtgtggtacctgacgggagtcgcagtccatctgctgccttcccgctgccatttctactcgtcaggaacaatggaaaggtgaaaaggaaagaggactacaagcaagatggcggaagagggacatacacctgactagtagtcgatcttacgaggtgcgatgggattagtagttttatagccttccagtgttccttaagaatggcggaaccaggaggacgaggagactaccgtaaagatggcaggctacctagcctctcccggtctccgctttccaccaccttgggcacctcgcccgcctgtggtctcgaaatcccccccaccagtggcgcacggcctgacgggagttgcagtctcccggctcccgtctatcatctcaagtcgagacaatggaaggggatggggcggggccaccggcaaagatggcggctgcagggccggggcgactgcgacatgggatgtgtagtccaggcgtctggcctcttccctgcggaaatgagggagaggactacgaaaaagatggcgacctcgcccctcgacctctgcgccggtgcctgctgggaaatgtagttccttgccgagtccaacagagaaaggacgtcgctgttgaaatgtgaatcccggcggacacgccaaattgcgaggcgacggaaacggaaagactcttttctcctc

SEQ ID NO: 349 - DNA, 50 bp, Homo sapiens
cggcaagcagccttgcacagtccatgaatgtggtcattcatccaggcttc

SEQ ID NO: 350 - DNA, 1024 bp, Homo sapiens
tggcaggttgtgcaaaaacaggtcgtgggccatatcgggcccccaggccactgtttgctgactcctgacctaagaaccaccgtcgtggggcacgtccagtcctgctctgaattccagcctcccttctgagcacctaaatggcttcttcccccggtgtcacaacgatgatttgcccaacagtgaagtttctatacattcttaattagataatttccttcctatgcagctctcaagtatttccttcccttttgaggagaatttcattttccacaacatataagcataaaaggtaacaaactcaaatcattttcattcatcagtcattcaacaaacatttgcacccgggaccttggaaaatagaaccggaggcaaagtggagatggtgagaggggatccaggaggaagcactcaggaaaggggtctcacacctgctgcgcaccctgagccatgtcacttctcctccctgggcctccgtctcctcatgtgtgaagcaaggggaccggcaagcagccttgcacagtccatgaatgtggtcattcatccaggcttccctggccagcctgtctgggtctagctgttctccctgcttcttcttgaaccctttctccttccccaaatcccctttgcctctccccagactgactcctacatattctgggccctctatttatgacagacccaaaagttaccctcctccccacccagagtcccccaccccacccccatgcacctgttaacagaaggactctgagagccatggctggaaggagccagaacctggaaggaggtgaaccaggggttgcaggcaccactgaggaaccacaaggaagccaccaaagcaaagaagggcagaaaaggagaagtaggaggcagaagtctatcagagattcaaaggaagagggcggaggctcagtgagcacatagccctgcctggtcttccgcccaggactgcccacagcctgcccacccttcctccccagcttcctgacccaaactttcaaagtcaataccactatccaaaagg

SEQ ID NO: 351 - DNA, 50 bp, Homo sapiens
gcctgagaacaccacttataacacgggacctatacgggagtggtgacacg

SEQ ID NO: 352 - DNA, 1024 bp, Homo sapiens
gtggactagaagaaaactccagagacaacggggtgggggagggggggggacttaaaaaaaaattcgatagataatatacatatgtttaaaatctaaattttatttagagatatctaaataaaatctctaaactaaataaaattttagtttaaaagattctaaatgttgagaaagcattgttattgtttacctggcagttctttttatttcttactagcgcataaataatggtatatcttataattaaggaagtcttagatttaaagaaatctaagctgacgggtgcagaggctcaggcctgtattccctgcactttgggaagccaaggcgggaggattgcttgaggccagaagtttgagaccagcctgggtaacagagtgagagtctgtctttacaggtttaaatacagtttttttctaagtaatattgtcataaatattatgtcatgaatattatgcagagctgccgacccctctgtactctgggcagttttccctcttgcctgagaacaccacttataacacgggacctatacgggagtggtgacacgccatctgttcaagtttaacttttttctcattttttagacagcaaatacaaatggaagttccagtatgttctgcccgcactccagtgggcggtcttgtgcacagcccacttgggaggcctcggcgctcaggtgtggtaagagctgggcggtgcagagcacagagaaaggacatctgcgaggaaagttccctgatggctgtcaacaaagtgccacgtctctatggctgtgaacgctgagcacacgattttatcgcgcctatcatatcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgc

SEQ ID NO: 353 - DNA, 50 bp, Homo sapiens
ctcaggctgtgggcgcctgaggcttcagctggggcaggcttggcctgtcg

SEQ ID NO: 354 - DNA, 1024 bp, Homo sapiens
tccccctcctgacccccaccttgcgccccttcccggtgttcccggggcgctgccgggccctggggcctgcggggcgcgggcggctcttggctgggccattctttcccggccccctcctcccttccgtttccgtggccgtgcggccggctagaggctgcggcccagcgcggagcaggggggctggcaggcgtcggggcggtcgggccggtcccgcccgccccttcccctccacaggcccgccccggggcctgggccaactgaaaccgcgggaggaggaagcgcggaatcaggaactggccggggtccgcaccgggcctgagtcggtccgaggccgtcccaggagcagctgcccgtgcgggtacctctagccccggggcctggaggagcggtgggagctgggggcgcggcaggcaggggcagagcaggcgttccgagggccagagacccacccaggtgggggtaggggccgcggaagggcggggatggccgcaggggcagggctcaggctgtgggcgcctgaggcttcagctggggcaggcttggcctgtcgaggacctgggcaagggtgtccctgtaaggggtggtgggtggaagggcctggggagggaggctccaggttggctcctgttcccgaacgtgcggaggagaccctgacgctaaggaagcaatgagggccagtccccaggccaggctgctgctgggtacccatggctgcgtgtgagcgaggcaggaccccacctcctccccgtctgcagtccatcctgaccctacagtccccagtctcctcgtcccatgcctccgtctccagctgctgccttgcctccagggatggccccttttctgtccccagaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggac

SEQ ID NO: 355 - DNA, 50 bp, Homo sapiens
acgtccatgcagagcacatgggctgtgttcttcccagtacaaagtagacg

SEQ ID NO: 356 - DNA, 1024 bp, Homo sapiens
aattatatctcaagaaacaccaacaggactgactcagagcctgtaaaacaccagagttctggaagagcaacatttctggaaacccggcatgtgaatcaagtgctgggttgtctcaagattccggcagaaactgtcctctgctacaagagttgctgtgcctggaaacccagcgtccaaactcgtggattcatcctggcgctcatttccacgtacgtggtagtatcaagtgggacacttcccatagaattcagccagaaaccctaggaaaagctcatgcatagcttaacaaaaatacacaaacacatccccaaggttgaagtacttacctctgtgcgagactgcagtctcttgttcatctcatagattcggtactctggctgtaccatgtatggtgtatgcctcctataaaatgggccgaaaggagaagaatagaaggggtcatgtggtgtgctggacatcttgcctgcttttcgaaaatcaagctaaacagagtatcagtaacgtccatgcagagcacatgggctgtgttcttcccagtacaaagtagacgcacgcacacacgctcacacacacacagaggcaggcaggcaggcaggctgaacacgctggctgggaactgctgtcggagccctctatagcaggagaggagagggagaggagaggagggagggaaagagggagggagggagggagcacgggagaggagggagagggagagagcaggagctccagagagggagggaggttggtatggaggaagggagggaagaagggagggagggagggagggaggagggagggagggagggggagagagagagagagagagagagagagagagagagagagagagagagagagagagagagagagaggagctggatagctttaggcaccactgcttgtttttaaagaagcagtttgtggagaggtcatttcctgtccacattgtagactagttcacaaatataattctcctcacagtctgacaagaggtctaaggtttggttttaatttttttcct

SEQ ID NO: 357 - DNA, 50 bp, Homo sapiens
cattactagggtgtccaggacattgtgtgactcaggaaacagctcagacg

SEQ ID NO: 358 - DNA, 1024 bp, Homo sapiens
attcccctacaacaggaagaccaagatttccccaaaaccggccagcatcttgcccatttgccagaaggagaaaaataagtcctggcaagagccaagataaggcccagaagcccctgggttcctttagccaaggtgagtggtttcaaattatgacaagttgcaggttctctgagaagcatctgtaataacctggcaaattaagcatcctctcctgggaggaggaatacagaactctgtaaccacccaatacctgtttccaggtcctgcccctcctggggcacagggcagccaccttgcaattctcatccctagaaaggagagaccagatcaacaaacagcagggctgggactgcccagggggttccgagattccttctcccctcctatcacctgccctccaggcacaccgtcctacttccccctacttccccaggggttgtcagggacagaaggcccctccttcatcccccctagtgttcctccactcttcctccgccccccattactagggtgtccaggacattgtgtgactcaggaaacagctcagacgtgaggcttgcagcaggccgaggaggaagaagaggggcagtgggagcagaggaggtggctcctgccccagtgagagctctgagggtccctgcctgaagagggacagggaccggggcttggagaaggggctgtggaatgcagcccccttcactgctgctgctgctgctgctgctgctgctgctatgtgtctcagtggtcagacccagaggtgaggcatggcgtgggtgaggtgaggggacccagctcccttaggaggatgatcagtggggtgggggaagagggccaagccccaggccgtgtgagggatgctggatggaggagattctcactgcccaaatagagacggcctccagggaaagacggctctgcccatggagctgcttcgggcctggtgccaggggtggtgactgctgggggatgggtgagagggtgcccacctccaggaagaacctcgtcagcactggcactggaggac

SEQ ID NO: 359 - DNA, 50 bp, Homo sapiens
cgcccagcctcgctgttcttatcttggcagcagattccgaatgtcggctg

SEQ ID NO: 360 - DNA, 1024 bp, Homo sapiens
tccatgagcaaccccgtgtctgaacagatggtactggtcaaatgagatttcagagctgcagaagagggtcaacttctctcccagcctcatcatggggtccacctgggtggagagagaaggctttttgtattttcctaggagaaaaagaggctgattttagaacacacgcctgagtgtatgaacaaagtaatctctctccctctttttttttttttttttttttcctttgagacagattttcactcttgtctcctaggctggagtgcagtagcacgatctcggctcactgcaacctcagcatcccgggttcaagtgattctcctgccttagcctcctgagtagctgggattagaggcacggaccaccatgcccagctaatttttgtatttttagtagagacagggtttcaccatgttggtcaggctggtctcgaactcctgaccttgtgatccgcccacgtcagcctcccaaagtgctgggattacaggcgtaagccacagcgcccagcctcgctgttcttatcttggcagcagattccgaatgtcggctggtgcccctgtcaatctcatgttcatctctagggtcctgagtcagcctatgtctgtgtctttttacttcctctgcatttctttgattctgcttttgactgagtccctgtggtttaccgcccctagaagccatatgagatgtggggttctcctggaaaatgggaattactctgtgctttgagacccttcagaaaacatagtgctggccttgagttctctgacatggggctacggggttatgagtcttactatttttcaattgtgtttgttgaaaaatataagaatctcgggaggatcagaaggaacctcacaggatcccactgcagggaacaactggctgtacccccaagcccaaggagttagacgtgactacttgttggggagggtagaagtgacccctcctgcctctttaagcagtaagacatgttaaacccctttgctgagcactttttcacagtccctctcttcctttattt

SEQ ID NO: 361 - DNA, 50 bp, Homo sapiens
cgcctagaggaacagagcctggttaacagtcactcctggtgtctcagata

SEQ ID NO: 362 - DNA, 1024 bp, Homo sapiens
ttcagactggaaaacgcacactcacatgtgcatctttaaatgatcacttgggctgtggtatggagaatggcgaccagtgaggaggcaggagctgttgtccgagcaagggatgatattggcatcttggattggcatggtggcagtagtggtagtgcagagtgacttgggtagattttggagccatttagaaggtaacatccacaggaactggtaaataaatacgtgggagaagttgggtgaagggggtgtcaaagattacacccaatttattttgcttgggcaagttggtggatggtgagcccctcactgagtgagaagcctggagaagcaggtttggagggtggtagtatgcaggtggtatgcatagttggggatgtgtgttgagtttgctatgtccggtgagcttcccagtggagatgtccaatgggcagacggatactcacatagagagttcatggtagattcgggctagaggaaagcacctgaggcctggccagagacgcctagaggaacagagcctggttaacagtcactcctggtgtctcagatattctctgctcagcccacgccctctcttccacactgggccacctataaagcctccacagatacccctggggcacccactggacacatgccctcagggccccagagcaaggagctgtttgtgggcttaccactgctgttcccatatgcccccaactgcctcccacttctttccccacagcctggtcagacatggcgctaccactaatggaatctttcttgccatctttttcttgccgcttaacagtggcagtgacagtttgactcctgatttaagcctgattctgcttaactttttcccttgactttggcattttcactttgacatgttccctgagagcctggggggtggggaacccagctccagctggtgacgtttggggccggcccaggcctagggtgtggaggagccttgccatcgggcttcctgtctctcttcatttaagcacgactctgcagaaggaacaaagcaccctcc

SEQ ID NO: 363 - DNA, 50 bp, Homo sapiens
cgcaccctcaagagtgtgggtgagacatatacagcctgttagacctgaag

SEQ ID NO: 364 - DNA, 1024 bp, Homo sapiens
ccacacgcttacaggtggcttatctgcaaaatgtgtctaaaaagaaattttataggataaatattttgtacatgtttgaaacagtgcttggcacaaatgaataaatgtaatgcaagctgctattaatacatcatctccgaattgggagaatcattgcgatcacatcgttgtgattacacaaaagcctctgtcatgtaatagggctcagtaaacgtcaatttccatagcatttcgagcctggatactgaaatatggggcaaaaagcaggaacatgcccctggtttggctcttgccttcttgcatttcctgggtttcctcatttatcttttttttttttttttttggccttgttatctttctaccttcagggaagcctctcccttcttctcctccctagaatgacctatcaccctccttcaggacctagatgcagggcgtttctatcttaggctgacacttgactccttgcctacatctatagcttggcacagagagattcacgcaccctcaagagtgtgggtgagacatatacagcctgttagacctgaaggtgagcccaacctgggaaaatcgtgacctcagagcagggcaggatgtgaaaggttttggaaaggagatagccctgcagggcaggagggatttttaaggggaggaagtgggttgggggaaatacccagtgaggagggaaacagatatgtaaattctacccttttctctacccaggcagatggctcttcttaaggccaataaggatctcatttccgcaggattgaaggagttcagcgttctgctgaatcagcaggtgagtccaagctttccatttcaaaggactggcctggagactggggggtgccggggaagtggaggaagaggataattggagctggtgaagtaatggtggagttgatggaaacaacgagagacacgggatacaatgcagaggaaagagaatgtgagagttggtgctgtggcactattctagtattcccgaatcccattgctgaccacattctcccttgccaac

SEQ ID NO: 365 - DNA, 50 bp, Homo sapiens
agcatgtagtcggtagtactatggagttcctgttaaggtccacgccaccg

SEQ ID NO: 366 - DNA, 1024 bp, Homo sapiens
tagctgtgtaccttcccttgctgctgacccgtaatgtcatcaaacgcaaacttcgtttcagtcgctctttctacttggaaaactgaaagcagaaggggcagggcagcgcctcttcagactccaatgtcttggttcagtggatcggaatatgaataaaagcagaaaactccgcctcagacaaaagttgtgttctcaaaaccctgagcttcaacgctgttctatgatgtttcctttgaaatgggaaataattttccaggttatttctgttaacttaaaaataccaagccactgatacgttctcacaaacaccaggcatcaccacagagacatcttctcaacatcacaaccacctgggtggggtcgaagccagcaagccatgtgcgatgactaaccacccagtcaccaggatgaacagattcagtttaccttaaagccgtaagaaaaaaccacctctaaagccataagatacagtttattattttttttcaccttcaaaatacagcatgtagtcggtagtactatggagttcctgttaaggtccacgccaccgcgacagcgagtgggcattgcaaggccaggaccccacgtgcaggtgcacactcacctgagcgcatacgtgtagcccgtgttctccggcacacactggggaggactgtacatgtgaagccgagaaaaatccatgttcaccacttcaaaccatactgcagagggcgggaaagaaatgcagagtgttttaacgggcaggaaatcgagcgcattcctgtctcagtcaacctgagctgcctacacgcaactcaactcaggtcaccctcaaaactcacaggaaacacggccagcagcagtgttttctaaacagacgagacaagtgtttccatagttacaagcccaggaacacttctatcataatctagtcccctcatatatcctgagaaaaagaccaggggaaccctaaagtggctgactcgtgaaaccaggggcaccttccaagaaacacggagagaaactcagagctctcttcaagatg

SEQ ID NO: 367 - DNA, 50 bp, Homo sapiens
cgcctgtgacttagccttggtgtcagtctcttgcggacctgacaaccccc

SEQ ID NO: 368 - DNA, 1024 bp, Homo sapiens
tcttggggttccagtgactaaactgctaaaatggttcacctgagagcaagaagcacactgccttgggacattttcattcactgcatcccatctagttgtgcccagtgtagaccaaatgtcatcatccaaaccacacgggacagaggcctgcatgcgtcctgtttggcaaacagctgcccagccagtgggggagcagttcatgcttagactaccaccccctccaggtgtcttaggcacgctggtccttaggagaagggttgaccttccactccctcttgcaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgacttagccttggtgtcagtctcttgcggacctgacaacccccatctctccttccctgattccctctgcctttccaggccccatccccctgaacagctcctccctatggtcctggctgggcctaaccctgccccagggcctaaccctacctgaggctcctccccttcccccggggcaggttgagaggctggagtgggtccctcagcgccctgggtgggtgggcctgcacagggggtacctccttctctgaggaactgggctgttagggattttccttaggccctttggtttccgcctacggagaggtttcccccattggttgctcttcctcagccagggttacttcctggtctgttcccctacccaataccccgccgctctgtcagcttgagctccaggtggagctccaggtggctcctcctctcccgggggaaggcggccctggaccagcaggcgggcctgctgtactcccgctttggggctgcagggaagctggccgctgtgggcggtctcgggc

SEQ ID NO: 369 - DNA, 50 bp, Homo sapiens
cgagtggttcacttgttgattgaggggcttatggagaagttgtatctcca

SEQ ID NO: 370 - DNA, 1024 bp, Homo sapiens
tctcagtaggataaaacttctctgactcccatcctgctgcccagatcaatagactgcttttcaaccttcttgaagaaaacaatgatgtcactttgaaaccccatttgaggatccctaatttcacacgagggttttcaggccacagcacttggaagatgtcgcctgacttctgcccagggagccatcaaagcacatggatgacagactcaccttgtgcacaggagcagagggccatggtgcagacgaggacaaggagggcagctgcaaggcccttcatgatgctgggcaggcagagaagtggtcagagtgagctggggcttggaaactcacaactcctggcctccttctggggtatgagctgttgtctctcctttttataggcagactggaccatgggaacattggaggtgctgatgcaagacattttaactatggtggtgtcatgtgagttctcagcccagggttgcctatggttacttgaaaggtttagggtacacaaacgagtggttcacttgttgattgaggggcttatggagaagttgtatctccagatgggtgaccaggagttggaagcacccagggattatgcttaggattatgcataatcatgtgattatgttttcacatgacagatatttctcagaaatgagtggtcacagcctcctttgatagagcagaatgctttaatggattttcacaattgtttttccttttaagagagtcacatgcttcaatcttttatatacagttaggcctttcgtgatctaatgagaaatcttcccctatcctaaggcaataaagatatcctcctatgttaacttgtagaagctttattgttttagcattaatatttaaattacaatccatctggagttgatttttatgtttggtgtgaagaaggattcaagatttattttttgccacatgaatacccaatggaccttggcaactcattggtaagaccattgtataagtcaggattccccagagacacagaaccaatggtgtgtgtataaaaaataag

SEQ ID NO: 371 - DNA, 50 bp, Homo sapiens
cgtctgtttctagtaagtcatactgagacaaagacaggtggggcaacttc

SEQ ID NO: 372 - DNA, 1024 bp, Homo sapiens
ctcaggcaggtccagggtgattacaggaattgagatctgctcggcatttggagaaccggccgcccctgggttagtgggctcagcgtcagactttacactggtcttctctgtgccaaccaccctcaggtggagggagctttccaaatctgtcatggagtttggggtactgctcatcgtgataacaatttttatgggctcatgtagactcagtgggtctccgggttgagaagtatcgatgagagtaacagctacctcactatctgaggagtccacttcctggtgcaagggcaggtccccctggcaggaggtatctacctgacaggatgtgtctgctggctcctccacaggcttggccacgatggtgtcacattgagggcagctgctgctcaggctgtcctgaggtgacttgctttgtacccgttcccttatggagccccggggacaactgacaggttctggaatcaggactgaattctcactcccccacggctggaaagaaacgtctgtttctagtaagtcatactgagacaaagacaggtggggcaacttcttcaagggtcccttatccactaagccaccctcggatctgtggcgcaaaggaggctgccccttgcctcctctttcctttcctttaccattgatgagagtttctgtggcaactggttttacaggtattactgacttggtcgtggtttccagcatgtgtgcttgagacgcaggtaagctttccactttgataccaggtgaggtagatgacactggtgctatgggatggtcttctaatagaatgacacctgaaatgacacatggcaactttattagcatcagaaatgaatgagtaatgcccaagagcaagacctaatgaataataacaaaactaaaacagcaccagcaactaatggaattagatacttttttaattttactttaagttctgggttacatgtgcagaacatgcaggtttgttacacgggtatacatgtaccatggtggtttggtgcacctgtcaacccgtcatctaggt

SEQ ID NO: 373 - DNA, 50 bp, Homo sapiens
aagatctgctggaggccaggcacagacaggtgctttaactcaagttatcg

SEQ ID NO: 374 - DNA, 1024 bp, Homo sapiens
ttagccaatacttattgagggatgactgcatgccagtcacccttctgagtactttacactcatttcatcttccagaaccctctgaagtatgatcatcatctgtttcacagacaaggaaactgaggttcagacaggtgaagtgattttccaagttaagtgcagaacagtgttcaaactcagggagtgggcccggtccttgttcctaaccactatactattctactctgcctctgtggcagcaggagccctgcctttctggccctttcatggaggtccatctatgtcacctgccccattccccatctctttggaaggagcagtggactgggagataggatgcctgggtcccggttcaggcttcataaagaattggctgaaggaccgggggtggtactggcagctggcctcagtcatttgaaaagtgaggtaacagtctttgtaatgaacctcctcataacctggggagaggccaatgagagagttcagactcacactggaccaagatctgctggaggccaggcacagacaggtgctttaactcaagttatcgctctccaaagcggttaggacactgtaaaacatatgcaaacaagagaaggcagcttccaagcatcatcctcttcctcctcttgcccctcccctggctaccaaaagttcatctccccttctagatcccccacttctccaggccaaacgggaaacacagctcccagcatccctccccccacatcctcccctcccccatggggccaaggagcagccaccctttgctggggtgtcactggctggcgcgggtgcttcctgccccgcacagataagcatcgcccccgccccctcccccactgccaataggccaagttccagtcccaccccccacctccccctcagctactgccacccctccctccctattccaggagagccccgtctccagaaggccttggtcctgctctctatcctttaccctccaaggcccagccacaggaggtgggtgcagagcagccaggaggtgggtgcagagcac

SEQ ID NO: 375 - DNA, 50 bp, Homo sapiens
cgagataaaaaggcttaccttgaggacagccttattaggagcagaggcaa

SEQ ID NO: 376 - DNA, 1024 bp, Homo sapiens
ctgctccttctttgggtccatactgcatttcagagctgtaacaccgtgaaggtatacagcttcactcctgaagccaagaccatgaacccactgagaggaacaagaaaaacaactctggacctgctgcctttatgagctgtaacactcaccttgaaggtctgtggctttactcttgaagtcggtgagaagcgagaccatgaacccaccagaaggaacacattccggacgcatctgaacatcagaggaaacaaactccagacacactacttttcagaactgtattaagaactgtaacagtcactgcgagggtctgcggcttcattcttgatgtcagcgagaccaagaatccaccagaaggaaccaattccagacacagaattatttgccttcttacttcctgagagttctaggcacagaacatacttgaggtgttatacaaaggtaattagaactgacagggaattgtatgattaatgacgtgggacatgagagatttggaacgagataaaaaggcttaccttgaggacagccttattaggagcagaggcaaacacaggttttgtgggtttgaagcctacacatttatagctttctctaattacacaggtaggaaattataaaatcaggtacaagggcttggcaggggcctaaagcttaagtgatgaaaaaaaaaaacaccacacctctggtgaaaccaatagcttacgaaaaagtagaaaaaagcgcgatgcatggggagctccggtagtcctttgaggtatttgagaggctgagtcaggaagatggcttgagcaccaggagttggaggtttgtaagtgcagtgatggtaaactgccgctgtactccagtctggcaatgtagtgagaccctgtctctcaaaaaaaaaaagtaacccttgcctgactgggacaataattgagaaaccagtaaaacaaaataataactattagccgggcgcggtggctcatgcctgtaaatcctagcattttgggaggctgaggcgggcggattacaaagtcaggag

SEQ ID NO: 377 - DNA, 50 bp, Homo sapiens
cggtccaaagcagaacagcacatgttagtgggccccactgggttggaacc

SEQ ID NO: 378 - DNA, 1024 bp, Homo sapiens
aaagggacagaggacacgggtgggaggcaagtccagatatagaaggccccgacccccaaccttgaattaattcacagccccccttgctctgccagcctggagaggaagatgccgacagagggctcacctctccagacatcaggatcagatggcacaaacatcggactcttgcctgagctgctgggaaacctgcacctgctgtgcaagatactcttatctcctagggacaggacctgctgatcacactatgggctctgccccttttaaagggctgcagaggctcaatgctggtgcagagaaagcaataaacctcaggtaggaggcggctctgaggcccagaagaggaaatttttttaaatctcaacagggcagggtgagggagtcagggattgctgaactttccgccagtgagggaaaaacacgccagcttggctgtgtcatctgggagcacactccaggctgtagaaggtgggagatgggtccagcaccccagctccccacggtccaaagcagaacagcacatgttagtgggccccactgggttggaacctcacatgttaagaaacagcaaacagccaggtgcagtggctcacgcctgtaatcccagcactttgggaggccgaggcaggtggatcacgaggtcaggagattgagaccatcctggctaacacggtgaaaccccgtctctactaaaaatacaaaactcagccgggcgtggtggtgcacgcctgtaatcccagctacttggggggctaaggcaggaaaatcatttgaacctgggagacgaagattgcgcagagccaagattgtgcaactgcactccagcctgggcaacagagcaaggctctgaaaaaaaaaaaaaaggaaagagaaagaagaaagaaagacagagaaagaaagaaaggaaagaaaagaaagaaagaaagaaagaaagaaagaaagaaagaaagaaagaaagaaagaaagaaaaagaaagaaagaaagaaagaaagaaagaaagaaagaaagaaagaaagaaagaaaa

SEQ ID NO: 379 - DNA, 50 bp, Homo sapiens
cctcacctccagaaaccttggatttgagctaatctttaatctgtaaggcg

SEQ ID NO: 380 - DNA, 1024 bp, Homo sapiens
ccacctttcaggggctgagggaccttaatagaccccccaactcgctgagcctcagcttcctcatctgccacacccagtctttggaaagtagacggtgtcgagaatatttctggaatttccagtttggtgggcaggtgctgggggcactgtgtggtaccaccttaggaagagccctggactagagccccagccccagccctgagacgccacgccctgccggctcagcagaagatgcagcaggaagtcctgagcccagggcaggctggcaaaatggggtgagtcagggattgtccgcaaatcaccaccctcactgatgtctgccttacagctgacggggtgataagatgagagctgctgcagatgaaatagttgagctcccaagtgcccattatgcatgcccagggtttagagagagggggcacacccaggctctgaaatagccacccaagaggaaacactttggggaggattgcagagcaatgggactgcccccagaaggccctcacctccagaaaccttggatttgagctaatctttaatctgtaaggcgccccagtcaggttttttgttacttgcagctgaagacaattaatagtgtaaaaatccccttgaactttgtaggccatagagtgagccaggctgcacctcacctcccaatggcaccaccacctctgatagcactggctcagcctccctgagctcagtttctccatccatcagatgggatgatgcctctaggtctggagcagactagagaccctctgttaacagaaggctcctgcctgcttattggcagaaatttttacagctgggctccctgccctgcctctctaggtgtccttcccatcacctcccagagacttctgctccagccaggcctcttccctctccctggaggcacctttcccactcccacctgctctgttcccagcctcccttctggcaagccttccttgatcttccttacctgggcaaatcctcccaccctcaaagccaacctcaaggctcccacacatgaggcctt

SEQ ID NO: 381 - DNA, 50 bp, Homo sapiens
gctctaccactggctgtgtgggcaggggcaagtctcttagcttctctgcg

SEQ ID NO: 382 - DNA, 1024 bp, Homo sapiens
tcatgtcttgtccctacatcaacactcaaaaaaattgacttctgctgtccccaccttgaccccttttcacaaataaagcagaggtctagtccttcaaaaaaaagtaaccaagaatcccccatgctcacctctggtcctgtaagtgatgcttgagggctggctgcctggaggcagctggttctttttacagaaaagttagacaggcaccttcaccattcaccaatcagaggcatagctgtgggtggaaggttcccgtcccagccgtggaagtcatttcagaagtaaaggtttgcaggcaagcaaggctttgtggagatttgggcatatatatgggggctgatgggggaggggtggaggaaaaagagggaggtggagaaagggaaattggtcatgctttcctagagaattacttcattgcctagtcacccatcactttaaggacaatacagcgatggggaaagcagcccctgaggtgagatgagacctgggtttgagttcaggctctaccactggctgtgtgggcaggggcaagtctcttagcttctctgcgctgcagtctctgcatgtataaatttttaaaaaatttgtcccacctccccccaagggcaagtgtaataaacagaggcaaaaacaacacagaggtgcttggtaaactctgtacacatgtaaatacattattactgtgcagcatacaccagtctccttcctgtcaaaataattcaataatgatgccctattcatgctgggacagtagtccacagcgaagaaataacctgtaagtacctctcctttaatccatcagggccaggaagttgaggagtgtttcctgacatgcagctacccatggtccctagggttataatcactcaaccaaaatgtgcctctccttaggttctggaaaccaggaagaataaggaaatgtacgcatggacaagcccagaaagctgggaggcctggtgctctggtgggctagtcttggcctgtgtggctctgaaccactcaggggacacagacagcgtgatgt

SEQ ID NO: 383 - DNA, 50 bp, Homo sapiens
tgccctcttctcagaaaacctttctggctgggactagtaagtggctcacg

SEQ ID NO: 384 - DNA, 1024 bp, Homo sapiens
tggttagcagatgacataggcccagtcttcagggtgagcgcaggaagatgaatgagaaaacccttcaattctgtgtagctgggctctctggggatgagaaactcaggggttggggggcacagaggaggcctcaatgcaggctagtgagggtggggagcaagacagtaaatggagctgaagctggggccagatgccaggtaggccacacatttcatcatcacatctctcagcaaccccagcccaaaaagctggcctcctttccaatcttcccagccaaagtccctggacaagctgattggaccaaccagagtcagatgctcatccctgactcatcacagtggcctggaagatgccacatgttgactagttggtagcagcaggcaggtactggtaccagtaaggcaaggctgctggatatagacacagaaggtcattaggacatgggaagttcctcaccaggctctggccctctttcaacctctgggcctttgcacatgcagtgccctcttctcagaaaacctttctggctgggactagtaagtggctcacgcctgtaattccaacgctttgggagtccgaggcgggcagatcacctgaggtcgggagttcgagatcagactgaccaacatagagaaaccccgtctctactaaaaatacaaaattagccaggcatggtggtgcatgcctgtaatcctaaccactcgggaggctgaggcaggagtgaacccgggaggcggaggttgcagtgagccgagatcgcgccagtgcacttcagcctgggcaacaagagggaaactccatctcaaaaaaaaaaaaaaagaaaaagaaaaagaaagaaaacttttccctccactctgctgggctgtttcattctcccctctaggtttccaatcttcgccttctcctggcagcccctcacattgtctcggcgggctctcaccaccatacactccatctagtgggtgaaggcgggcctaggcccgtgagggcaaagcctagcggccatgatcaccccgaggtgccc

SEQ ID NO: 385 - DNA, 50 bp, Homo sapiens
cggactggccagagaagaaaccccagcagctaaggatacttaatccagcc

SEQ ID NO: 386 - DNA, 1024 bp, Homo sapiens
agggggaggacacagcctctgcgagatgccccagagtgggggcttcaagcatcaaagaggagcactcccgaggtgtagcaggcatgttagctgtttgtccagcgccatctgaaaagatctgtctatttgaggcagctcctttcggctttttactctgttcagaagggttttccagggcccatgcccaccctcttctctgtcccccacccaaatctcccatttctacaggggggtgctccccttgtgctccctgtgcagttcaattcgtgacacccccatacctgtgctccgtgttgctctgcgctgccccaagctggcttccgctgcctgctctgggctgggctgggctgggctgggctggtaggacctgctcccagggcgggaggggacacacccacctcagcagatctcagcccatccctcccagctcagtgcactcacccaaccccacacgggccaaggagagagtgaagaggaagcattgccctcagaggccttcacggactggccagagaagaaaccccagcagctaaggatacttaatccagccccgactaggaactgcccccacccatcgttcagatattcctgctgtgtctgggaactcttcctggcacacccaccgtctgatgccagatgactaacccaccagcctctcgctgtcctcaccggttccccctgggtgtctgtcttcctttcctaggtctgccaggtggtttagtccatgctactcgtggcttagtccatgccactcgtggcttgtgccccaccctgcccggggccctcttcatgacagtgctctgctaggtcctgcctcccactgagcacacttggctcccgcatcgagcagtcactaggctggatggttcctctttgcttaggtctgtttctcctcagcccgttgtcttgtgtcctcgggccagacaacacagagacaagtggccctgtgggcacagggctgggcatgttgtccatgctcaataaataaaaacaagttcaagttttttggtggtaggtggaaaag

SEQ ID NO: 387 - DNA, 50 bp, Homo sapiens
cgtttctcaaactctgtcatgctgagggctgcagtgacaacattttagga

SEQ ID NO: 388 - DNA, 1024 bp, Homo sapiens
cctgaatcatttgcatggtttaatctcttagtcctcccaacagtctattgggaggtattactaacagtctgtagggaagtactattactagccccatcccaggattacagacagagaaactgagacacatagcagtttcaaagcttgtctgaagttactcaattataatatgtcaggtttgtgattggaacctagcactataacttttgagatgatgtgtttactacagtgcattcctacttctgtaaatctcttctccttcctttctctgagcaaacacataaaactgggaggtaggtaggagaattgggatgacattcatttgtggaagtccatatactgtgtcatattcttcatcttcagcacttttaatctctaaaacatagtgcagtatttagcaggtcatcaataatttttgttgttgggtaaatggctgatcgaatgaattaacaaaaggactggatactccatttctgatcaccatagagataaccaaattacgtttctcaaactctgtcatgctgagggctgcagtgacaacattttaggactagaacacattacttggatttcacaatacaaagatgattgcagttgtccctggtaagctcagcccacagagcctttcaattcagcttggggtgagctgcacttcaggcatggggatataatagtgtgatgaaccattcttctgaaggttcttctgaaaagctgctggtcttgggatactgtgagagcccctctcattgctctttagaagtaatttaaatttttctgctacattgtctgctcagctcgtattctggtcatagaggaacctgaagccagagaaactagacaaaaaggtaagagaaaaccaagcaacaaatgcagtctcagctgttgctaacgttattcacaggagtgacaaactgaatgaatcttagggtgagagactggtctttttacctcatttacacttttccttggtctgcactgtagatcagcagaactcatttatcctaagaaatcgatgactaatttt

SEQ ID NO: 389 - DNA, 50 bp, Homo sapiens
atcatcaaacaccctgcagcacctacgtaaaggcagttggagctgggtcg

SEQ ID NO: 390 - DNA, 1024 bp, Homo sapiens
accttcctggaggaggtgggcagctcagactccacatgctggtggtgcctgaggtctgatggcctctaataaactgtgtcctatatgcccttgggtgcatctctgctaggggagaggccagcatgggtagcactccttgcccccattttacagattaggggaatcaaggcctcttttttttttttttttttttttttttttgagacggagttttgctctgtctccaggttggagtgcagtggcacgatctccgctcactgcaacctccacctcccgggttcaagcgattctcctgcctcagcctcccgagtagctgggactacaggcgcctgccaccatgcccggctaatttttttgtatttttagtagagacggggtttcagcatgttggccaggatggtctcgatctcctgatctcgtgatcgtcccgcatcggcctcccaaaatgcagggattacaggcgtgagccactgcgcccggcctcaaggcctccttcttgcatcatcaaacaccctgcagcacctacgtaaaggcagttggagctgggtcgcagcacccggctgagtcacgccagcccggccctcccggagctctgcgtccccgatccggtcctgcataatcaaatacagtataacaaagtaccgataaccgggacaatggggctgtgtgctccggaccgtgggagcccggggccgccgcagggaggccgagggaggaagccacagggcagggcagggcagggccgggctttgcagggggcagcgctgtcccagggtgaggggtacgggggcgggattgcaaaaccctagcgtgcgcccgatgatcagctggggccgcagaggtgggcctcgcacaggaggccgcggctcgctgatactgcgagctggcaaagccgaagctgggcgggggtccgggcggtgggagccaagtcggatcagggagtggcttgtaactcggcggccgattggacacgaagaagagagcggggtggggctgggagggttgggggtccggagcgggggcg

SEQ ID NO: 391 - DNA, 50 bp, Homo sapiens
atttgctttgcaggctgtgtgaaacctgggaccacttctgccttcctacg

SEQ ID NO: 392 - DNA, 1024 bp, Homo sapiens
atctccacacccaccactctcattgcattgcgcagagctcagccatctttctcatccgtcaggcattcctgagaaagagggccactctacctctcttgctgccagccttcactccagcaaggagggtgctgggtgacctgagcccacatagccccgagtgagcagtgaggctgtctcctgccctcttctgcctggagggctcgtcagtgtccccaggtgtcaggccctgcctcctgacgttggccttttcactacaggcacccgaagcacacacagcagagtcctctggactttgaggaagaacccacagcaggaggaagtcagcagggagtggtgagatggggagatctttgcctggggagaacctccacactctaccctccccaaaatgacttggggaaccctgggaagaaaggactccatccctgcttgggggtgggggcagaggaggggtgcttgggggcgtaggttggggtgggcattaacaatgctctcatcccatttgctttgcaggctgtgtgaaacctgggaccacttctgccttcctacgtggcagtggctcagagttatttgagtgctgtcaaactgagctgattgctgccctagtattagatcagtccatagaaagtgggagcaatggcactgacactgctagaggattggtgcaaggggatggacatggaccccagaaaggccctgctgattgtaggcatccccatggagtgtagtgaggtggaaattcaggacactgtgaaggcaggcttacagcccctgtgcgcatacagggtcctagggagaatgttcaggagggaagacaatgccaaggcagtcttcattgaactggctgacactgtcaattacactactctgcccagtcacataccaggaaagggtggctcctgggaagtggtggtaaaaccccgtaacccagatgatgagtttctcagtagactgaactacttcctgaaagatgagggccgaagtatgacagatgtggccagagccctgggatgttgcagcctcc

SEQ ID NO: 393 - DNA, 50 bp, Homo sapiens
cgggagaaatagactattacccagatatattttgtgaatatgacatgacc

SEQ ID NO: 394 - DNA, 1024 bp, Homo sapiens
tgtcagtcatcttcagctaagatctttcacatgcagttgagagagttaaattatagaagtgtgaagggatatgtatcagtgaggaaacagcccaatctctaaactgctagcaggaaacttcacaaaagcagaagtaatttttcaggaaatgattcaaatttgggggctgcctatagaaattaatattgtaagttgctatttttttgccccatgacactgtagatgctcactaaatatatattaaattgattccccatctcacctaattctgttgagcaaggaaaaattgctctcaagtccagcaatttcagttatggaaactaaaataaaagtgagagtggttactagctatgaatttctctcggaattttttctctgctttgtttccttctgaaaaagtagatgtatgccaaatgagactgacttcatcatttcttggaacttttgggcagtgataagcaataacgaaatggactgttgggtgcatatgcctggaatcacgggagaaatagactattacccagatatattttgtgaatatgacatgaccacatcttccccaaaaccttgtccaaattgtgtgatggtctttacccttcacagtatcagaaattccattatattttttctctttgttgtcttattttttttattattatacttcatgcaaagataactaaaaagaagagcaaagtaaacaaatacattctaacatcttagtaatttgtttttagtaggtgaaaagttaataaaaagttagagtaggccaggtgtggtggctcacgcctgtaatcccagcactttgggaggccaaggagggtggatcacctgaggtcaggaattcaagaccagcctggccaacatggtgaaaccccgtctctactaaaaatacaaaaaaattagctgggtgtggtggtgggggctgtaatctcagctgctcaggaggctgaggcaggagaatggcttgaaaccgggaggcggaggttgcagcgagccgagactgcaccattgtactctatctagc

SEQ ID NO: 395 - DNA, 50 bp, Homo sapiens
ttccctcttacctggggacttgctacttcctgctggaggacaggcaggcg

SEQ ID NO: 396 - DNA, 1024 bp, Homo sapiens
tgccccctgttcaccaggggtgaggccagacatctggaccacatctgtggctttaaacactcccccagggctggcagctggactcatgccttcctggagatattctcattctctctctctccctgcttcaccctctccctctgttcctcctctcttccctgtctttgcctctctatctgtttcttacttctctccctctttctgcctatctgcctgtctgtttctctccctctctgttcctctctcccccactatctctccctcattgtatctttgcttatctctctatctgtcctttttaattatatttacttctctctctatttctgtcttttctcactctctcccctctccctctccctccctttcttcctctctccacttccgtctttatctccatggccctgctctctgactctcatggcactgctatctctgcctccctctctctgtctcccttttctcttcccctccccttcagctctcagctgggctgtgggttccctcttacctggggacttgctacttcctgctggaggacaggcaggcgggcaggtgctatgggtgactagagtccgaccccccattttatagtctggcagacatcaggccctatagtctgtggcacaaaggggaagctggctcagcaggcctgggcagggagtgggggactggggccctgacctcgcctggatcactgcagacagcagcactttcctttgtgagaccagcacacacagcagaaaccctggccacagcagcttcaccttccaaccctaccctgactcctttctcaacaaccccagccagggatgggcccccaaaagggtccctgctggctgccaacatggggcagggaaaaggggagaccctgggaggcaggagaccagagtttgaatcctgactcagccactgcgcgctgtgtggcttttggtaggtctctacccctaggggggcctctgtgtctgcaattataaggtgggcacgtgtccctgttggatgccatatagaaaagaaggtgaca

SEQ ID NO: 397 - DNA, 50 bp, Homo sapiens
tgtgtatttgagacagggaactgttcctgtccccagccgatgaccagacg

SEQ ID NO: 398 - DNA, 1024 bp, Homo sapiens
cctgttcttccactgacaattaccatttccagtaataggtgtaacccaaagttcttttttgtttttttctccttccctaaccccacctgtttatactcttgcctatatatgtgtatttgcagaccccacacattcccagatacacatacattggtcctacatgtttcccctgtttccagctgccatctaagtgagcctgcactttttacatgctgaaaatcttttttcaccctctatggcctcctaggtccttgggaataattgggagggatgaagggactcctgcagtccatgaggaagaggacagaagtgagcgcccaaccaaaatgaatgctccctttccaaaatctctagctgaatgccttagcaggagtggcagggaaagagatcttaaccccacctccagcaccaaaacctaaatccatctgctcagggcaggcaggaagaaatgtctattttctcctgtttcaggtcatcctatcctcgagttatccatatgctgtgtatttgagacagggaactgttcctgtccccagccgatgaccagacgcccatctttcttccagtgggttacttctcccccatcagtccttcgctctgcgcccgctgacccagtcggggctggctggtggaagagggcggggagagccttctagttggcgagtgggctttaggacccaacgggaacccgtgcctcttgcagcagcctaacccagaagcaggggggaatcctgaatcgagctgagagggcttccccggttctcctgggaaccccatcggccccctgccagcacacacctgagcaggtaggaccatgcacaccccttcccaattctttggccgcctttgaccccggcctctgcttctgatctagccatttccttctcgccagttctggctttccccatccctcctctcccgtcgctcactgtagtcctgggaggtgggagcctgggaacagtggggtgtctgaaagctcagagccctctgcaccctccagcacccttcctgcatttctcctgag

SEQ ID NO: 399 - DNA, 50 bp, Homo sapiens
ggtgggcctctgagatggcccttagcagatgtcctgcgatgcactgcacg

SEQ ID NO: 400 - DNA, 1024 bp, Homo sapiens
tgtgactcagtggcttggtggggactctttcttattggttgcttctaggaactccacccagcttcagcaggggacacacttccctctacacttcctgtcactccttctgtccacttaggtaatggaaacttgtttttagggagcagccagctgagacacatggtccctgtatacttgaacagccatggaaaagctgcaaggcagcttggcgctccctggtgataattacttcatctcatctcaacaaatcagattctcaagaccagctgctccccggacttgcttattctttgttccaaggagacagttcccaatggatgtgcccctgtgaaaacaccctagtaaacatttgctttgttattgaaatttcactctaaaatcccaaagctaggtcaagccccattgctagttttactgatgaagaaatcaaggcatttttaaaagagtaacttgttgagttggcgggtgcttgggtcttttcggtttctgtggcttccaggggtgggcctctgagatggcccttagcagatgtcctgcgatgcactgcacgcctcttgttgaaagcatcaggggtgacctgcctgcgtctggaaccacagcagcttcaacttcctccacacacttccttctgtgggaaggtgaccagcacaaacccgctctgaaaagtcttggggaccaaatctctgtctgagaggaaggtaggtgcagttcatccactaagtttatccacctgttctgtgactcctcttcaccattctcccagcaacgactgagcctcatgacttgggggctgggggatgaggtggaggtgggggatataatataggagatggtacagtgcaggggcagaggctggtgtgttctccaggacaagtggcaccacgcactgaaagacttttcaagataaacacaactttgtctcttcagcctggcaagagctgaggcactgaaaacttcttttttcccctagaaaatgacacactctcctcctaagggtccctttgattttgtcctggtggaaagc

SEQ ID NO: 401 - DNA, 50 bp, Homo sapiens
cgccgcagacatgtgagattgagtaattgctaaattattttcagagtgaa

SEQ ID NO: 402 - DNA, 1024 bp, Homo sapiens
ctagaagataaagtttctgaggcccaggaaaactttaacattccttatctaactcatggcagaacctggattagaaaaatggtctctgatacccagcaccacttctttcagctccttcatccctgggacagtcaacaggggagtcagttcccagagccatttttccccctctctctagtctcttcctgacctgagaatcagagatcagagattgataaaaagcaaatgttagatgagaacacagagcctcccgagttgagccagaggcccagagtggaacaagaaacctggaactattcaggatggggtagacaggagagtggaagagaatccggccggactcacctgtgagctgccaaaggatatagatgagggtgaggcatgttggggaaccagccatattgctctctggaagtcagccactgaaatgaagccacttccctcttaggtattactcagacctcttccccagctgatatttaaagaagcaggaggggtcacgccgcagacatgtgagattgagtaattgctaaattattttcagagtgaatagagcattttaccttgccaccagcaatctatgagagatctatttgctccccatcttcatcagcatttggtatattcccattttatattttagctgttttaataggtgctgtagtgatacctcattgtggctttaatttgcatttccctaaagcctaataatgttgaacatcttttcatgtgcttatttgccatctatatatccatatcctccttggtgaaatgtctatttatgtcttttgtccattttataatcagattctttattttttttactgttgagctttgacaattccttatatgttccaagtataagagtcatttgtcagatatgtggtttacaaatattttctcttggtctgtagcctgtcttttcatcttcttaacggggtctttggcagagcaaaaattttaattttgatgaaattcaacttatcagttttttttctacccacactagggtccaaaggttttc

SEQ ID NO: 403 - DNA, 50 bp, Homo sapiens
tggggggctcagggtcctgggatggtctcgcagacactcctagttcttcg

SEQ ID NO: 404 - DNA, 1024 bp, Homo sapiens
agggaagctctcccacaagctgggcagctgcacctgaggggggggtgtcatgggcagaacactgggtggaggggccagtcttgccatcagcagcaaggagggggcggagattccttttcttttttttttttttgttttttgagatggagtctcgctctgtcgcccaggctggagtgcaatggcactatcttggctcactgcaacctccgcctctcagggtcaaacgattctcctgtctcagtagctgggattacaggcgcttgtcaccactcccggataatttttagtagaaacagggtttcaccatgttggtctggctgagtctcgaactcctgacctcgtgatccacccgcctccgcctcccaaaatgctgggattaaaggcgtgagccaccgcgcccggccaagggggcggccatttcaagaacacattcctcttccctcccggtgcgcctgagaggaggcgcttcatgtcgaagtcagccctgggatgcagagagttggggggctcagggtcctgggatggtctcgcagacactcctagttcttcgcctgccccttctcatctctatttctgtgggggcggggagggcagacaggaacagggctacccttgaagcaggttgggggagggggatcctaacaggaccccggtgcctgtggacagtgacagggtcgacagctctggggctccactctcctttccctgaagaccccagctgcctcagtggcttctggcttgcacccagcaccagcgcagatgccccgagtgccggcggctcgaggtcggcccgcccgtccggacctgtttcctcctctgctctcctgccaacgcctgcccatctctgtttcccccacgtccagcacgcgcttcggggacggccagagccaccatgccgactggagagactctcctgattcgggtccttgtgtcccggggcccgggcggcttcgcgcggcgacaaccggcgcggtgggaccaccgagacgccgggacctccgcgcggcctagagtggtcccggaa

SEQ ID NO: 405 - DNA, 50 bp, Homo sapiens
cgtgccaaggtgtgacatttatgaatttcgccaactgggaactgtgcaca

SEQ ID NO: 406 - DNA, 1024 bp, Homo sapiens
agccttctcttaacacaaagcagggtgttgtatcttcatctgacaataagtgacttagttaactttgatttaattttggcttttgggaagtcatggggaaaagaagtaaagctgagggtggcgaaatacctttgctaaacccagagacactgcacctgaatcctgctcagtgttttgtaggcaaccaactgccttctgccactggtatccggaaggggaaatgagttaccttaagtgggccaaagtggggaaatactaacagtacagctagaaaccaagagctgtcgtgaaagccctgaatgggttcccactgctatttcagacaaaactgatgcagttaagcctgaatttcctggcaagcacaagggtagatttttccaaaaggctttttagactgcaaatacacagcctttccatgtctaatcacaaaagcaaactgctggacacatgctctctgttcccagctggttgtgtatgttttcttcacacttcaacagaaacgtgccaaggtgtgacatttatgaatttcgccaactgggaactgtgcacacaaatcgttcttgcttgtggtgtgggaaaatgatgaatgggggctgttctgcctggggaggagggctgctgtcactctggcatgcctacagccttatttattacacaccaaagtataaaaccactccgccgctgcagctctcagctccagtcctggcatctgcccgaggagaccacgctcctggagctctgctgtcttctcagggagactctgaggctctgttgagaatcatgctttggaggcagctcatctattggcaactgctggctttgtttttcctccctttttgcctgtgtcaagatgaatacatggaggtgagcggaagaactaataaagtggtggcaagaatagtgcaaagccaccagcagactggccgtagcggctccaggagggagaaagtgagagagcggagccatcctaaaactgggactgtggataataacacttctacagacctaaaatccctgagaccag

SEQ ID NO: 407 - DNA, 50 bp, Homo sapiens
tagccagggccagccaagcaggcacagatgctctgctatgaaatgccacg

SEQ ID NO: 408 - DNA, 1024 bp, Homo sapiens
aacatatacatctctggaagtgaggatataccaggccccttctttaagctgttatgtcttaaagctgaaatgttaacttcagtgataaattcctcaggcagagcattggcacctggctacaacagggttaatgagcaggagtagggtaggtggggtcacaaaccaggaacacatgccctccaagttagatagctttttttcctctttaattgccgtttaaacacacatgctctcacataacacagaaggtgagagctgaatgaagttttctgggtaatggcatgaaatgttttccttatgagaagtggtgttgagttacagcgtgcagacggagaacggggaggagagaaacggcagtctcaatctggcccccaccttttcttgggcttgtaggaaggtggacatgggctcccggagacaagacaagtgatatgttgaactgttcggtggctggaatcaactgctcctggagtgacctaaggccagtgtttatcagaacttagccagggccagccaagcaggcacagatgctctgctatgaaatgccacgcaggcagagactgacaagcggtaggaactgagctttccccttggactgctgcttcctgctgtgttcaggggagggggtcactttctggcaactctgctgctgctgctgctgctgctgctacttcagcttcctctccactcaaggtaagcaggctaagggagggcaggctgctagggaaagctttgtaccatgaacaggatccgaaagtttttccgaggaagtgggcgagtcttggcatttatctttgtagcttctgtcatctggctcctctttgacatggcagctctccgcctctcattcagtgagatcaacactcgggtcatcaaggaagacattgtgaggagggagcggataggattcagagttcagccagaccaaggaaaaattttttacagcagcataaaagagatgaaacctcccctaaggggacatgggaaaggggcatggggcaaagagaatgttagaaaaactgag

SEQ ID NO: 409 - DNA, 50 bp, Homo sapiens
ggaaatgtttgtggtggggctgctatgtttcgtgccggtccgccggtccg

SEQ ID NO: 410 - DNA, 1024 bp, Homo sapiens
gtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaatggggatttaaagtgtgggcgacatggaatgaggggtgggtcagtgatcttgagctcagggcagaagccaggaattaagaagggaaatgtttgtggtggggctgctatgtttcgtgccggtccgccggtccgccgttgcgctgttctgaggtctacgaagcgtttgcagccccgtcgccagggccggccagatctgggtgggcctgggcagcgctcgctgggcggtgccgatttctggcaaggggggcgcagtctggatgtaatgggcgaggcttagcagggcggaatgggcgtggcccgaagaagccccgccccgtcccgcttagacaatgccccggagccgccagaccgtcgcgcccctgccccatcgtagtatatgagctcgcctacacaaggacccgcgctaaaagccagagctcccagtccccgaggcttgaagacggggactcccttctccaccaactctgtcctcggggggtggggccccagccgagatcacagcgcgacaggagtgggggtggccgctggaggtgagtcttgcgtggggggccctgaaccgtgtgggggccggagtttgggggtgccgggcccatgcctgcaccagac

SEQ ID NO: 411 - DNA, 50 bp, Homo sapiens
aaacttattctactccccattcatccatagcctactgttgctatgcatcg

SEQ ID NO: 412 - DNA, 1024 bp, Homo sapiens
ttgccttcaaatcctcagtcacagagactattatctgtagtttcttgatactttttcttccctgtcaccattctagtgcaacactgtgaagttaaaaaaaaaaaacaaaactagatatgtaaatcagtttctttcctgacaaaaatcttactcgtatccaccagcaaaactattggtgtcctcctcattccatagtcagaaaaacagccatacctagaatttaaacagctggtccaaggttactccgaatataactaaagagataaaattctcccaacaaagttcccgctttagctaagagcaagaaggaataacggcaatgccctaagttgggtttctaagatgcgatcaaagaagtgaacagttagaaaagagtttacctgagacctaagatcagatcctgtaccatacaccaacttttcatattccaactctggactttaaactgaaccaaaagtatttcctcaaattatcctcaattcttctgcaccctctgctttaaacttattctactccccattcatccatagcctactgttgctatgcatcgtcttccatgctaccttggttaactcacatttttgctgtggtccatagtcattctgggcttgggttgccgtaggcaactctaacatggaataaataacactgtcagtcatcttcagctaagatctttcacatgcagttgagagagttaaattatagaagtgtgaagggatatgtatcagtgaggaaacagcccaatctctaaactgctagcaggaaacttcacaaaagcagaagtaatttttcaggaaatgattcaaatttgggggctgcctatagaaattaatattgtaagttgctatttttttgccccatgacactgtagatgctcactaaatatatattaaattgattccccatctcacctaattctgttgagcaaggaaaaattgctctcaagtccagcaatttcagttatggaaactaaaataaaagtgagagtggttactagctatgaatttctctcggaattttttct

SEQ ID NO: 413 - DNA, 50 bp, Homo sapiens
gcagttcaacttctgcagcgtgtacttcacaggcacaggtacttaggacg

SEQ ID NO: 414 - DNA, 1024 bp, Homo sapiens
ggcaactaagtgagacccccgccctgccaaccccctctacaaaaaatacaaaaagttagctgggcgtggtggcatttgtcagtaatcccagctactcaggaggctgaggtgggagaatcgcttgagcctgagaagcggaggttgtagcgagctgagattgagattgtgccactgcactccagcctgggcgacagggcgagactccatctcaaaaaaaaaaaaaaaaaaaaaaaaaaaggcataggtccatagccctttagaactggaagaagccttctaggccaagcccttcatttgaactgagccttgacgggtattagccgttagccatttgtggaaggtcgcacagtagtcaggactggaagtctggtctttgaaacctgtcagtccacggtcatttcacctgcctgtttgtaaaacaatgtcctgttacttaagtatactttttaataagaaaaactgggtgtaagcaagagtatcagagtggtgttctggtgccagcagttcaacttctgcagcgtgtacttcacaggcacaggtacttaggacgtcgcacaggcacaggtacttaggacgttgccccgccgagactgtcgttcatatcgcgcccacctccgggtaacgccggtaatgctgacctagctccattatttgtattaatttatttagctagcagggggaacggctgggtaatgcagtctcagctgctggaggggaagaggcaagactccgccggcgcccaccatcagagcgtgacaacaagcgggaccggaggttgggaaaaagcacagggacagaatgaatgtgtgcatgggggagctctgctggggagagggcaagaggctgtgatcagattatctgaggtttcagaacttttatataaagaccaaggaaccaaatgaaaatccaactcttccagggagccctggaaagttcaaaggacctcgtttgagggagcgagtccccgcagctcgtgcccacgtctccctcgcgcttcccccaggacaggggccgccccaacccg

SEQ ID NO: 415 - DNA, 50 bp, Homo sapiens
cgtcagggaatttccacatctattgcctcacaacaaagtggaacagttcg

SEQ ID NO: 416 - DNA, 1024 bp, Homo sapiens
ggttctatcatatgttttccttccacaacaatcacagttttgaggttcattctttatttttacctttcagattccagcctctaagtctctccttgataagaaccttgggaccatcatgaatcccagataacacactataggtttaatacaaatattaaaccttgagccccacaagctagcttgggcttgggtagagacaaagttatagatacattgacaaagacggcctttccactaaggagatcagaatctccttggcagccactaaaatctcctagtcacactgttaagagacaccctgattattttgggatttctctatcttcccctctaacccacttttactctgaaactcaccaagacacaggagggtggtctgtttggggtccatcgtgctgacacggcctcagccccgttgctctcctttcaatgcacattagcaggatgacagatattcttacgacaataagctccgcaggaagtatgaggacagagcccctcgtcagggaatttccacatctattgcctcacaacaaagtggaacagttcgttgccgaataacttagttccaggttgctcttgggtggagcccaagagaagacatatatatgtatatttttttaaatagagatggggtctttctatgttggccagggtagtctctaacttctggcatcaagaaatcctcctgcctaagacctatatttctatttatgtttcagatgagaaacgaatgagaagtgaattttcattaagccagtgtctaatggtgttcaaattcatctttgaaccagatgctacatccaaatagacgggcttgggacagaatataaggtggtggataccatacaggcagacattgccttcactgggccattagtcaaaagctctgtggctttgtctgttctgaacctatgtttcatctctgagattcatggtctgagtatatttacttggacttgaccaggcatgcagtatacccttatcctggagatgatctcaatgccagagtgtggaggcattt

SEQ ID NO: 417 - DNA, 50 bp, Homo sapiens
cgcccagctttgcagtgccagaaagctgttatctcagcactgctaaggaa

SEQ ID NO: 418 - DNA, 1024 bp, Homo sapiens
gctggcggggcaggcagggacccctcccagggctcacagcttccagcggacagcaggcacagggctgtggggatcagagcacaggcagaagtcacctgacagcaggttcccgaggcttcaggcctggaggagtgaggacggctgttgggttcttgattccagcagagggaggctgtgcagggttgcaggaaggacggttgggggcgcttcggggaggtacgagaagcaaaggtgtttgcagcccttggggccaggcggcgggaaggcctgtagacgccagagggcgctcgtgctacatgcaactcaggagctgctggcacccgccaaggagtgctgagcgcggggagcccaaaccacagccttggggaacccaggaggggccgggcgggtgcaggacccgcatgagggattccgagagcacgatgtttaaatgttgggggaaaaaatggatcaaagcgatgtgttcccagggagcccctgttttctcgtttcttttcgtacgcccagctttgcagtgccagaaagctgttatctcagcactgctaaggaaaccccagcgcggcctcggagggattaggcattctgctgaaccagggatatgcggtgggcctgaaaaagccatttcgggaggaatctggtctcggctggggtccggccggcaccgtgaacaccacgtgaacaccacgtcggaaatctgctgggcagggagatttcctcaaggcctcccagggaggagagccacttcctgggctgcaaagagggccccaacctggcttctgaattcagagggggctgtgtgtgcacgtgtgtacgtacgtgcatgtgcacgtctgtgtacccatgtctgtggaagtggcacacgtgtgcatgtgtgcactcagtgtacgtgtgcgtgcctgtgggtagctccgtgcgcacatgcgtacacatatgcctggtgtgtgtgtgcacacgtgtgtctgacgtgtgtgtgctttgcgtgttcttgcctgggaaggagttcccggtttgggtggctctcctg

SEQ ID NO: 419 - DNA, 50 bp, Homo sapiens
cgtcacttcttggctgatgtatgagaggtaactgcttgacagatcaagat

SEQ ID NO: 420 - DNA, 1024 bp, Homo sapiens
gaaagaagattgaacctaaagaggttgaagtggcatttcacccaaaaatgctgagaatgactctgcagatcatctcaccctccatgcctgtaaatgaacatccttgcctccaaaacaggaaagcagaaccatgaactgttccaccaatgtgctcggcaaatgaatacactgggcagtgcttagtgatcaatgaactcaggcagatggggtgtgcttgccttacatgtactgtgtcctggatatgggcatcaaggaagggtttcataacaatgagaaggaagaacgttaggattgaggaagtggagatgatacttcctcttctttcgaaagagctttactctctgatcagctttgaatgttagttctgggttgactgagtttccagagctgaggctgctttaagtagaatcctcaagcttggcctcagagtactatgaggcttctgaatccaggaataagactgctcttggatttactctctttgtattgcatgtaagtaacgtcacttcttggctgatgtatgagaggtaactgcttgacagatcaagatggcaaagcaatggataccctagcactctccttagagtagtgaggtaggaaatatgactttggggatgtaatattcactcagctctctgtaatctgggaagccaggtgctaaagattctttaattctgtgaaagctttgaaagaggagagagttgtgtactcactctgcttttatgtttcttaaatgggtgttgtcttgataggtgtttagactgcagaccacaggtttgatttagaaaagcacaattcagcatgtatttgggtcctgaggagttcatttggggaagcactctggggccgccctctttcgagaaagtgtgttctttgcaagggagcttcctttgcatggaggcagctgggggacattttacactttgataaaggtctcaggcttgccaaaatatctctggtataaaaatgaaagctaggtgttgttggttcagagtcttttagtaagggtgtctggggcacttga

SEQ ID NO: 421 - DNA, 50 bp, Homo sapiens
tctcctggggtcaggatgatttctgtgcaggctgcagtgagccgtgaccg

SEQ ID NO: 422 - DNA, 1024 bp, Homo sapiens
atggggtggagacagggaaccgctttgggtggccagggcagcctccctgaggaggtgacagtttgaggtctgatggaggtagaagcaaaggcctgaggctttaaggaacaggaagaagcccatttgagaggacctgtggggaggaggccagggagggccaggaaggcctccgggcactgaggcctgggaatttccttctgagccgcacaggaggctcaggtgcggttgagtcaggggtgacataacttgctgctagtgttggacctgggtgacgggcaccagggtcccctggactattctctttccttcagtttgaaattttccactataaaaagcttaaaataggccaggtgcggtggctcactactgaaatcccagcactttaggaggtcaaggcgagaggatggcttgagctaaggggttcgagaccagcctgggcaacatagtgagacctccgtctgtacaaaaatacaaaaactagccggtcctggtgggctaattctcctggggtcaggatgatttctgtgcaggctgcagtgagccgtgaccgcgccattgcactccagcctgggcgacagagggagacaccgtctcaaaaaaaaaaaaaggttataaagtgctgctgcattttcatattacgattattgaccgctgagggtgactgtgctgtgaggcccgccggaggcaccagaaggcacaagcctcccactgcccctttccccgccaagtcccgcaggtctcgcagtcgcgggcgcccccaccccacccctgcccaaggccagggtcgcagtcccaccgggtgacggcagtcgcgctccgcgtggggcagcggcgagcggaaagggaagccgggcggggccagggggtcaaacacgggcgacagtcccgcccagccccggacctgcagcgcgcacaagctcgggcgccctccgagcgccgcgcccaagccccgcccctcccgcttcccgggctccgattggccgagccaccgcgggggcgtgtccggcggagctggccgggaccc

SEQ ID NO: 423 - DNA, 50 bp, Homo sapiens
cgagaagctcagcacttaggtggaggcataaacaggagaccaatctggtc

SEQ ID NO: 424 - DNA, 1024 bp, Homo sapiens
gtagagaaacagctgaagaagatgagattttctgcaagaaaggaaaacctctccacaaaaaactacaaaacccccagtgccaccaagtcaccacatacaggggttggactggtagctctctggatcggagggcaaaaacctgcaggctgctccacagacctctaggaaaatgtctaaataccttctgagatcattataaccctgcttctttgagaaaaattatctaatgaacaccattttggtgtgcgtgcctgtgtgcatgtttgtacacactctggattgcctggaataggagcaaaggcaatcctgttgtatactttgctgagtcagggtttaaattactgtccaaagttcaaaaaataataataaagagaaaaagaaaaggctatgagagcaaagcacctgattaatttcttctccttccagaactacatccatgggataaagaaaaaggcatgggggaaaaggatgaaaacctagaaaccagtggagatgagcaacgagaagctcagcacttaggtggaggcataaacaggagaccaatctggtctgaggagatggccaggtcaggctcctcagaaggaagtggagcataaggggaaacctgaagggtaaggaagcatcgggcgggcttgctaggttgaagtgctgggaggaaggttccaggcaaaggaaaccaccataaattgggaaagagctcagtccatttgaggaaccacaagaaggctgacatggccacagtatgaaaaacagctctgggtctctctttggtaatttcagttcctgattcaaggcgaactgtggttttaaagataacaatttaaagtgcaggaatgccacagagaaactttccctttgtcacgtaagagggtcccagaacaccctttaggacccaaatgcattctgtttctaatggaaacaggaagcttcagcttcccaagaaaccataagctagttggcttcaacaacagctgcttcaacaaaactgtgaagttccacattagggtttccatcttcaacaaac

SEQ ID NO: 425 - DNA, 50 bp, Homo sapiens
cgccgggactgccaactcaccaggttatttatagtgacaagagagtgaga

SEQ ID NO: 426 - DNA, 1024 bp, Homo sapiens
tctccctcagcgacccctctcgccgagtgaagggtcgagggtttggggcacaaagggcgcagaacgttttttcctgtgagaggaacattaagactcctgggagggctggggctaacgcctccgagagccccacctggtcagcctagggttagacgtgtagccagggtgctgggagggggccgctgctgggccccagatagaggggtagaggccgctcaatcacggagccaggccccacctgctgtagaaaccgccaccgagagccggccgggcttgctgcacgctctggattccgcctgcctataggcgaggcacaagggactgcgagaccaggcctgaaggcagagaggtcagcaggctcgggggcctctgctccagcggacaacaagcgcaccgggcgggaacggccgcctccccaggcgctgcagcctagctctcatgtgacccacggaacttagcccctctgttctgtttgcatacctgcaaattgtgggcattcacgccgggactgccaactcaccaggttatttatagtgacaagagagtgagacagtgggcttgaaagtgttttccagaccaaggctctgtcccacatataggtggattaactgtctggcaaaggcaggtgagtaacgttgatgcctatcagctctcatgtggatactgtttggactgggatgtagttctttgacctggggtgagctgtatagcaaccctggagggatgcctatcacacattacagtatctgaaagacactcacattctgaccctcacaatgtagtcagtccatttccaacaatgctggttttaaaggatgtaaattgcagtgcagggagttgtcagacaccaaggagtaatgatcaaaatatgatggtcattggaccttatcttgggagaaagagctaaaactgtgttctagatagtctcacagacttgaacatgctttggattttaggtttttgcaaatcaggcttgttctaatattttctcccacatgctatggtaggagccccatgatctctt

SEQ ID NO: 427 - DNA, 50 bp, Homo sapiens
gggaacctcagtgttttcactggaacagtagagattgtccttctgtcccg

SEQ ID NO: 428 - DNA, 1024 bp, Homo sapiens
ttgatagacccagtggagaaggtaggggtgcaggtctgggtggccatggtgctagcagaggaaggttgcagcttagcaaggagctcaggttctggactctcaaggcctctatggagcatttatgtacactcaccattgggtgttggcatggtacacatctcttgctcttgggaaagcctgttcctaccccagatagctaatattagaatgtgatttttgctacccatccggaaccccatgccttgtaaaaaaaaaaaaaaaatcaaatcgttgaatttggtttgctaagtcaggactctccactgttgtcatttcctagcagaatatgagttttattgcctcttcaaagagtctctgcaccagatcccataaatcgggagtggctgcacgaatgacatttggttcctgctttctccacctcccttcccctggggatcctcatctgtcccttgtcacttccatccactgctgccacgcctcatagctgctcacccctgcctgggctactgggatggtaaaagggagcaaaggaactaaaattcagggagcacctgtgatgtaccaggctcattgttatttcatttacacctcgtaacaaccctaggaggtggctgattttatcttcatttttaccagtgtggaaactggggctccgaatggtttaatagcttgctcagtgtgaacaggaagtgactggcagagcttgggtctgaaactagggctctcagacaccaaatcctacttccttgccccactgcttccccacacaactggagtcaagtctgggtacccagaatttagggacaggagacatagttcaaatcctggctctgctactaatttgccctgtgatactgagcacatcatttcctccctgggaacctcagtgttttcactggaacagtagagattgtccttctgtcccgcctgcttcacacagatataaggaggatcgaacaagaagtgaaagtgttttgcaagccactgggtcctgcagaagtgttggttggttaggttaggttag

SEQ ID NO: 429 - DNA, 50 bp, Homo sapiens
actcacctgtcattgaaatgccgacttcaggtactctgggagtgtgagcg

SEQ ID NO: 430 - DNA, 1024 bp, Homo sapiens
catacaaaaagtagccgggtgtggtggtgcatgcctgtagtcccagctactcaggaggctgaggcaggagaattgcttaaacatggaggacagaggttgcagtgagctgagattatgccactgcactccagtctgggcaacagagtaagactctgtctcaaaaaaaaaaaaaaaaggagtttgaggctgcagtaaactaagatggcaccactgcacttcacacctcactctagcctgggtgacagagcgagaccttgtctctaaaaaaaaaaacaaaaaacgaaaaaccaaaaaaaaaaagggtgggggtggaatagaataaacaactctgagaagggacatgatctggtgacaatctcaagtgaatcagtggttgaaccaggaccagatcccagtgccccatcttctggggacgtcctgggtctgaatcttcaatgcatgtcccttctgcagtgccttcctctgtggccctcaaagggaaactgaagcctttgaggacatgaagactcgcattaggccaacgaggggtcttggaactccagatcaaagagaataagaaagacctgactctgtgtgtgtgtacgtgtgtgtgtacgtgtgtgtgtgtgtgtgtggcagaggggggtgtggtcatggggtattgacatgaatacgcaaggggcaggaagcatctgaaatcagagctaacttgggaggcacagaacacggggtgcctggaaggggaacagatgtgttgtggggcacagggcaggctgggaggggaacaaaggtccactccatgggtaaccagacccttccgccagggctggccacttctgcctttggaaaatgtttcacaacgccccatgttgtgtgtgtgtgtgaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctga

SEQ ID NO: 431 - DNA, 50 bp, Homo sapiens
tgttattgcaccctgaaagttagactccaaacccacatcctcattccacg

SEQ ID NO: 432 - DNA, 1024 bp, Homo sapiens
agataaacttagccagacaagctggtccccctaccaagaccattccatgcacagaacttcttcaggccctggggccaaggtgggggtaactgggcttccagaaagtttaaagggatcttcatacctgtaatttggagtctggaaggttgcacccccgccagtcttcatgaggattcacaatgctgacgttcgtcagaaggatttggagagatagacccaatttggttttctcaagtagggtctgatcaggtcagaccctgggtcaaacccatgagggtctggtctttctattaatccaagccagttcttgacctttctcagtggaatggtcatgtactcacatttctggtttctcaaagactcatttattcatgtaacaagtatctattgagtgcctcctgagtgccagggagatctgtgattatttcacacattccctacatcctactagcaccctcatacagcaaataggagccaagtggagctggtgtatgtttctctgttattgcaccctgaaagttagactccaaacccacatcctcattccacgcaaagactttattccagagacagggtcaggttcacttctgcatcttggatttggggaaacccagatcttcctcagagaagatatcctgggtggagggaaaagcctggttctatcattagaggttcaaggcacccaccacctactagctgggtgatctctggcaagttactgagactccatgcctcatttgtaaaatcagggaataaataacctgatgttacagtgtcaaggggaggacccagtggggccttgtgtgtgaaagtgctgtgcaagctgggaaaggcaaagtggatttgctttcccttgctgccctgttcggagccccacctctgccactcccttctctgagctccaggcctgcaggcttggcttctctgtccttcaccgaaccttcacagtggctctgcaagggattactgtcccttctttatagatgagagaatggacgctcagggagatgctgggacttgcctg

SEQ ID NO: 433 - DNA, 50 bp, Homo sapiens
cgcccgccctcacagccctgctctgccttggtgagatttcaagatgggga

SEQ ID NO: 434 - DNA, 1024 bp, Homo sapiens
ggacctgggtcttccctgaagcatctccagggctggagagacgactgccatggtaaggaccccgtaacgctgagctgatggacgggctgaaggagggagggagaccccatggggaggctctgagagggaggaggagcccacggtcaccctcgcctcaaaggggctgactcaggaaggcaccaggtctatttgcggctgtgtccccgtcctcagtgagataaagataaatcaggcagacagtggcccgggggcagggagaccccatttctctctgaaatgcctgcagagagcctggtgcctgcccccacttcagccctggggaaatcagagccaggttcctggggtggcagttcctcttcctgtgggctgaggatgagacaaccccatgacaagaaggacccagcctccgagcggccacaccctgtgtgtctctctgtcctgccagcactgagggctcatccctctgcagagcgcggggtcaccgggaggagacgccatgacgcccgccctcacagccctgctctgccttggtgagatttcaagatggggagggggagatctgagtcttggaggaaccccaccccacacacaagccctggtccatcaggagacctcaaaagctcaggaggcacccgggcggggacctgctcaggcttcagggcaaatgcctcacagggaactctcttccagggctgagtctgggccccaggacccgcgtgcaggcaggtgagtctgtccccagctgtcccaggtccctactcctcactgggacagggggccacccatgggcagctgggggaggagacagtagttctgggtgactgatggggatgatggggaagtcctggggctgggagctgggatctgagcgtggggatgtcttgggatccagcctctgatttccatctagggcccttccccaaacccaccctctgggctgagccaggctctgtgatcagctgggggagccccgtgaccatctggtgtcaggggagccaggaggcccaggagtaccgactgcata

SEQ ID NO: 435 - DNA, 50 bp, Homo sapiens
ggaagtgaaagtgtctagctacataaatagcaggccaatcccagcccacg

SEQ ID NO: 436 - DNA, 1024 bp, Homo sapiens
agcctgggctagacatcgtgaaacctcgtctctacaaaaaaaaaatagaaaaatcagccaggcgcagtggtgcttgcctgtagtcccagctcctggggaggttgaggtaggaggatcactcgagcccaggaggcggagatttcagtgagccaagatcaaccactgcactccagcctgggtgacagagttagaccctgtctcaaaaaaaaaaaaaaaaaaaagaactcttacaatttaataatcagatttgctggaaggaggggaagggtatggatcctggagcgtagtgaggagacagtcatggtgttccaggggagaggcagtgaggcctgcatgaaagcagtagctgggaatagaaggaaggctcaggcccagacatattcaactaatgaggacataaaatttggcagctgaggactgtccacttagtttgagataagtggggctgggtgccagcaaatccagctttcaggaaggaaaaggagtggggataagttaagggaagtgaaagtgtctagctacataaatagcaggccaatcccagcccacgcacagacccccaacttgcagctgcccacctcaccctcagctctggcctcttactcaccctctaccacagacatggctcagtcactggctctgagcctccttatcctggttctggcctttggcatccccaggacccaaggtaccaaggcagggaggggccttgcatggggctaaggggatcaagaggcctggataggagcttgccagcagcccctggctccctgtgaatcccaccctgcaggcagtgatggaggggctcaggactgttgcctcaagtacagccaaaggaagattcccgccaaggttgtccgcagctaccggaagcaggaaccaagcttaggctgctccatcccagctatcctgtgagtggacacaaaggggtgggtactggctggtgacggggtggggagggcatggtgggcaagactaagaaggcttactagcccccacccgcaggttcttgccccgcaagcgc

SEQ ID NO: 437 - DNA, 50 bp, Homo sapiens
cgagatgacactgaacataaaaagggcttaggccaagtccagatacatgg

SEQ ID NO: 438 - DNA, 1024 bp, Homo sapiens
gggagaaagagaggaaggaaggaagaaaggaaggaaaggaaagaagaaagagaggaaggaaggagggaggaaggaagtaaaagaaagaaagaaggaaagaatgaaagaaaaagaaagaaagaaggaaagaaagaaagagaaaggaaggaagggaggaagagagaaagggaaatattggaagaaaggaaggaagcacagaagggaaggaaggagggagggaagagagagaaagaagaaaaagaaataaagaaggaaagagagagagagaaagaaagaagaaagaaagagagagagaattgaaggaaggaaggaaggaaggaggaaggaaggaaggaaagaaggaaggaaggttcaaaatgttccccaccatttcgagtagacctgggcatgaatctgggctctaccactcacttgctctgtgttctcaaaaaaaggaaacaaggcttcctcatagccaagcagtcctacaagcaacccccttttcttaatattagggagaacgagatgacactgaacataaaaagggcttaggccaagtccagatacatggaacatttgcaagaaatagtagatgctcatttaaagacaagtgaggagaatcccctctctgaccgtcttcactggctggggcacagcaccattatctattgggattttcaggctccctgtgcacctgccccgggaggtggaaggagacctggaattggtaccatcggaggagagaccagcgctgggaccaaaactgggaacctagagcaagaggccaggtccagagagagggtcaggaggaaaagagaggccccaggggtttgagggtgagaggtgagtgctcatcagaaaagctcaaagaggaggctgaggcgcagaggtgctcggaggggcttcccatacctgggcccggatgctgggctggcttccatgtgcttgtcccttctcggttcctggtctgtgtcctcccgctcttgcgacttgctcaaggcgtggtgttaagatcttcaccaacattctcttaggattcaggagc

SEQ ID NO: 439 - DNA, 50 bp, Homo sapiens
gggtggctgccctgctcggtgctgttctgtcaaagagccgaaattcttcg

SEQ ID NO: 440 - DNA, 1024 bp, Homo sapiens
ctgaatcttgaataggagcttgtccatagagggtcacggatctcccacacagagagcaccacaaaatcctcagcaatttggtgagagtatggtacaagatgatagtggcctggggcttgaacaagaggctgagtgcggtggctcacacctgtaatctcagcactttgggaggctgaggcgaacacctgaggtcagcagttcgagaccagcctggccaaaatggcaaaaccccgtctctattaaaaatacaaacattagccgggcatggtggcaggtgcctgtaatcccagctactcaggaggctgaggtgggaggattgcttgagtgtgggaggcggaggttgcagtgagccgagatcatgccactgcactccagcctgggtgacagagtgagaccctgtctcaaaaaaaaaaaaaaaaaaaagttagacgtctagtacaggaaccatgcaacacatcgagtcagccaagggcaaggtaaggagagtgatgaggaaaaaggggtggctgccctgctcggtgctgttctgtcaaagagccgaaattcttcgcggggtggcagatgaggacaggaacagctggggtgtggcaagtgttgctgcctggggagagcggagggtgaggtgtttctcacgggtgcatccagtgactcatcaggacagcggagctcatgaggccatgtctcccgtttcctgccttagaatcacatgaaaatgagcagagggtgggtcatcaggacagggctctccggggagcggaagcgccttcaatgcaggcctgtgggcaggggcgtgggggcgcgcacacacacacgcctgggtgacctctacgtatatacagagcctccctggccctcctggaaagagtcctggaaagacaaccttcaggtccagccctggagctggaggagtggagccccactctgaagacgcagcctttctccaggttctgtctctcccattctgattcttgacaccagatgcaggtaagcagagatgaaagggtgaggtgacggccagggaaca

SEQ ID NO: 441 - DNA, 50 bp, Homo sapiens
gcttcttctgggatacacattctctaggtcttttatccactgaggtttcg

SEQ ID NO: 442 - DNA, 1024 bp, Homo sapiens
agagttgaaagggagagtttaaaaaacattaaattcaataaaccattctgcagatgagaaatgtggggctctccaaaagttgtaaaatataaccacagcagagcccaagaaagatgtgactcgcaatacaacgctcatacaccaagagactaagaaagcttggcctctttcctgtcttagctccagttctaatgtggacaagaaggacctctgcacaaactgagaacatcctgccagtgcaaagggttctggctactgctgcatttttgtccattcaggaaagatcaggtggttcccctacaacagttgcattggcttgaaattttttgacactaaggtcaacggaaagactgaagtcccaggaaaggaggaagattacttcttctacagacctgttacctcttccttcctcaccaaatttcctgctgaattatcaaccccatgctcacctgcccagagagacttctggtccatggtggttgctcccatatccttggccagcttcttctgggatacacattctctaggtcttttatccactgaggtttcgacagcctgtcctacacgaaagaagcaagaagtccagggacttcccctggcagacttgtgaaacttcttggaaatgaagcccagatttgagcaatgccaactctgacctgtcagaaattagttgctgtgaagtcagctgctgaagagcccttttcatctagtctcacctaaaagggacccggtcctggagaagggaaggaggtgatactcaggctctgcctcctggtatcaccctcggccctgaatctccttcctcatcatcccaatctgtctccttcttcttgcccccacctctctctgtgttcacaccacctctggcttgcttaatttttttagaaacaggatcttgctcttgctgtatcaccccagttggagtgcagtggcaccatcatggctcactgcagcctcaacctcccgggctcaaaggatcttcccagcttggcctccagagtagctggaaccacaggcatgcacc

SEQ ID NO: 443 - DNA, 50 bp, Homo sapiens
aagggtagctgggatcccagggcccacagtgaccagcaacacacaggacg

SEQ ID NO: 444 - DNA, 1024 bp, Homo sapiens
caaaacatcctcatgacaaacaacccacactgacgggagccaggccccaaccaggcctccaacctcatggcctgccctcatggcctatccctggcaccaagggaggagaggccccaagggggagcagatggctcccagtgtgatggggaaagtggtgggtcaggacaaatgagaaacaggtaaactgggggcctttcaagatatgagtcatggagggcttcctgcaggagggagctggaagaacaaatggggaggagaggaggacctggtgatgggaaggagagtagagaggacagccagggtggggaggagggaggcagggggagccccaagctgagctgggctggactgggtagaaggaaggagaggactgcgcaggaccctcccagcaagaggcatatggtaggcagagtctgagaggcgcagctgggctcagagccctcccagggtttcacctcgaggcaaaactgtccctaactggaggcagaagccagcccatgaagggtagctgggatcccagggcccacagtgaccagcaacacacaggacgcatgtgtcatagtggttaaaaggttctaaacccaaagttcctggattccaggcctggctctgccacttgctaattttgtgaccttgggcaagttccatcacctctggtttcctcatctgtaaaatacagcttataatagtacccacccatgggggtgctgcagggatttcatgggtcaagcatgtagagcaaggcctggcacacagcaggggccacatgagcacctgctgttgtcgtatcccaaagcacatccccaggtgtccccacagtctcatggggagagtagtggctcaggacaaaggaggagcagctaaactgaaggcctcagtgctggagggaagagggaagtctttcaacctgagtcacagagagcttcctgcaggagggagctggaagaacaaatggggagagcagagggcctggtgatgggaaggagaatagagaggacaggcagggtggggaggaggcagggag

SEQ ID NO: 445 - DNA, 50 bp, Homo sapiens
cgcacctgacttcaacagaagattattttaaactgtgtgactgggctggg

SEQ ID NO: 446 - DNA, 1024 bp, Homo sapiens
cctgacgtttgagctccccatgacaggagcttcagtggggggcacaggcagggtggggtcactctcccctaggtcgggggttcagtctcaggaggaccgagcagacggacatggggctgtgaaggtgaggattgcgcctgttgatacacgccaaggacacggaggggagcccagcctgcaggaggccggggaagctgaggctgtgattgttgtattgtggggcttggtagacaggaaagtcataagggaaaggatcaatatgaaaagagcagacactattcccatcctcacagctctctgagcacaaggacatttcccttcaccactgctatctcatgaggcctggttagtgcagagtgtgaggggtctgctggccctggggctttgctcctgcaggaactgctcctaggggttcaggtgaacaggagacgtggagcaaagacaccagccccggggcgtccaccctcagtgatgggcgcgattttctgagagaagaaacacgcacctgacttcaacagaagattattttaaactgtgtgactgggctgggaggaagtgggaaaaatcctgcaagctgcagcccccttagatccaggccagcttttcttgaaacagttttttttgagcggggagaaacacaagacatgtacataaaagtgtcccctaaaaaccaactcagtgattcacacaaaataagcacccttgaagaactagaacacaaaagaactgtcaagtctgtcccttgaaatgaagaaagagattttattaattcattcacccttacattcccctttcctattggccatgcccccgctccctcctgaaggagcccctagcctcactttaatgataatagtcttcctgctgttctatgtagttttatcatcggcacatgctgccttgaaaattctaacttcacgtaggttttcctgaagatgttgtatacatagaaaatcccagtctgttttcttccatacaactgcattgatctgctcagcccacactgtcccctaattgtccataa

SEQ ID NO: 447 - DNA, 50 bp, Homo sapiens
cgccagaaggtttctccatgctgtggagacttcctggaaggagtcacacc

SEQ ID NO: 448 - DNA, 1024 bp, Homo sapiens
tgcccaaagcagttcattggtggtagttatatatatttttaggtgcctaattttggttttgtaaatctgttattcaaatactgaatgttacagtcattgattttagtgaagaatcaggaatttttaaaatatctgcataagaatgacaaataacagggaatatgttttttgtctaccagggtcagtttggtctgagggtggaggaatgagatagagaaggtagagggagagagatcaagaaaaagaaagagaaaaaagaggtataaggagaaaatgcaaaactcagttaatatgtcataatcaggccatgggagattctgggcagggttgggtagtggaaggaggtagagtgattaaattagttaccatgtattgaacatgcatgatgtgctgggtactttactagtgctatttcattgaattttattcttcacaatgacttttggaaagacatcatcattctttttgacagatggggtaactgtggcttaaaaaacttgcccaagttcacactattcataaggggtagagctaaaatctttcctgcccgcttcgtggtgcgccagaaggtttctccatgctgtggagacttcctggaaggagtcacacccgcccttctcttgggtggtggcagctggcgccagtcactatgtatttatttatttttaattatttatttttgaaacagagtctcgctctgtcgccaagctggagtgcagtggcgcaatctcagctcactgcaacctccgcctctcggattcaaacgattctccttcctcagtctcctgagtagctgggactacaggcgcccaccaccacgcccggctaatttttgtatttttggtagagacggggtccaccatgttggccaggatggtctcgatctcttgaccttgtgatctggccacctcggcctcccaaagtgctgggattacaggcgtgagccaccgcgcacccggccgtcactatgtatttataattactgttctttgaaaatcgaagtaactttcatctacccagtgct

SEQ ID NO: 449 - DNA, 50 bp, Homo sapiens
cgctcagccctggacggacaggcagtccaacggaacagaaacatccctca

SEQ ID NO: 450 - DNA, 1024 bp, Homo sapiens
ctggggctaggctgaccccagctagatttttggctcttttataccccagctgggtggacaagcaccttaaacccgctgagcctcagcttcccgggctataaaatgggggtgatgacacctgcctgtagcattccaaggagggttaaatgtgatgctgcagccaagggtccccacagccaggctctttgcaggtgctgggttcagagtcccagagctgaggccgggagtaggggttcaagtggggtgccccaggcagggtccagtgccagccctctgtggagacagccatccggggccgaggcagccgcccaccgcagggcctgcctatctgcagccagcccagccctcacaaaggaacaataacaggaaaccatcccagggggaagtgggccagggccagctggaaaacctgaaggggaggcagccaggcctccctcgccagcggggtgtggctcccctccaaagacggtcggctgacaggctccacagagctccactcacgctcagccctggacggacaggcagtccaacggaacagaaacatccctcagcccacaggcacggtgagtgggggctcccacactcccctccaccccaaacccgccaccctgcgcccaagatgggagggtcctcagcttccccatctgtagaatgggcatcgtcccactcccatgacagagaggctcctcgagggcacgctgggcctcctcgtggctcagagcagggtcggggaaggtgcacccagaggtagtgccaagggcacaaatgggcatctcggggctgaggggggcagggcaagggcttggctctcccagaagtgtattctccaactcaaaaaggcccactggccttcatcagtgccaggctcagagagggcagtattctgccccagttgcccagcatgccggggcagaggactggcacccaggccttggcctcccctcggtgccttacccttactggagaggatttaccaaggcctgacaccagcctcctcagccccctacccatacgccactaaagc

SEQ ID NO: 451 - DNA, 50 bp, Homo sapiens
cgcaggcaggtattgaacccgtgaaaggttacgcaaatgtatgtttgaaa

SEQ ID NO: 452 - DNA, 1024 bp, Homo sapiens
tagcatcctgcagatctcattttcatactagggggacaaggagggacatgggagtcagtggtaacaccatggaccaccagaggatcgggatctggaactcacaccaagaagcaccaacccttcagggacttgtgcatatggagaacctgggtgcccatggtgaaaagcgttctaggctttcaaagtaacattgcatgtgaggatggagaatgataaaacgattcctgccttcaaggcatcgtcccggtgtttgtcagctgtggggcaacagcaccctctgtgtcagcaacctgcatgaagagcatcatccctgcaagtcctcaaggcctggggaggcctcatcccctcctcatttcagcaacagcacacaggacaatacgctctagaagaactctttgacttaaaggtatatgattgtttttgttcctttaacatgaacgtgagtctggagaaacagctacggccatcccagccctggccaaggggaaaatgccggaagactccagggtgggaggaagcgcgtcccaaggcccaggatctgcgaggcgacttggggaaaacgcaggcaggtattgaacccgtgaaaggttacgcaaatgtatgtttgaaagtggaaatgaaacaaggattttctctgccacacagacagcaggttggcgaaaagttaaaagcgtgttagtattcaggggaggctgcgttcagagaagcagctaccttcagaggctgctggtgaccgtgtgaccagctggagcccttttggaaagtcaactagctagagctgttgaaagttgatatctgcatatcctttcacccagatatccctttcctgggtgtctgtctgctgcaggggatttgtttattttatgggttgaattgtgtccccttccccaaatgtaactgtttctattctcaaccccagagactcagaatgtgactgtgtctggacacagagtactccaagaggtaattcaggtgaagtgagttcattagggtggcccctaatttaacatgcctggggttctta

SEQ ID NO: 453 - DNA, 50 bp, Homo sapiens
agagaagttgggtcctaaggccaagggcgcctgggccctgcagaggagcg

SEQ ID NO: 454 - DNA, 1024 bp, Homo sapiens
ccccagtgcggggacgcctctctggggtgcagggcacgtgcttggggacgctggcgagagccccttaccttcacatccgtgtccgaatcgctggagctgctgctggagtcggaagagctgtggtgtccttgctggatggaggtgcggcagtgaggcggcgccccttacccagccccctgaagttggaggcctaaggcaggaccctggggtcaggggcaaccccagccttcccgcccctccgcagccggtgatgaggcgacttacctttggacccggacctgcccctgcctccgaccggccctgaactttgtggggactgagcttgggatctcccccgtggcccgcccccacaccgggcttctgggaggtgggctccagggctgtggagagaagttgggtggttggtgcaggcagcttctgggcttgagtccggccccctgcacctccagtccacactccccaggagctcacctgctcccaggtcgaactccatggcggtaagagaagttgggtcctaaggccaagggcgcctgggccctgcagaggagcggagcagggggaggagcgctgagacctgcccgttggaggaatgctgagacgccccacccaacctctgtcctggtcctcagccctgactcattgcccggcaccacccaggatttcctctgtgagaagtgggggagatggacaggtgactgcttccgccagccttggtgcctcaggggaggccgactgaggggggctctgtggatggcattcggggagctacaggtttcccccaaaagctcagatgctcgttcttgaagagggaggtgctgcccctgccttcctgcgtaccgcgacaatacagcttcctccgcggcgctttaacacgcagggcgctgctgccaggggcgtcccgtgttctaactcgctcccacagcccctccggcttggtgagcagcgtctgaggggtgaggggcatagacttggagccagcctgctgcactagatgccagctgtgtcacttagcagcaaggtgacc

SEQ ID NO: 455 - DNA, 50 bp, Homo sapiens
cggactaaagtgaaagcaagtgtattagagaagtgagaaagcaaaagaat

SEQ ID NO: 456 - DNA, 1024 bp, Homo sapiens
cctgtcactcccagctgtttccagtgccgccctttttttttttttttttttgagatggagagtttaacttgttcgcccaggctggagtgaagtggcacgatcttggcctactgcaacctctgcctcccggattcaagcgattctcctgcctcagcctcccgagtagttgggattacagtcgtgcgccaccacgcccggctaatgtttatatttttagtagagacgggttttcaccatattggtcaggctggtctcgaactcgtgacctcaggtgattccctccccccgccccaccacctcagcctcccaaagtgctgggattacaggcctgagccaccgttcccggcctcgagcgccttcttataaactggatggtggtttttgttttcaccttcaaagtcgaatctccctagtccgtttattaccagaaagaggtctccactcagacccagcgagaggcttcttggatgtcgcgtaggaaagaattcggggcgagtccacggactaaagtgaaagcaagtgtattagagaagtgagaaagcaaaagaatggcagagcagggcattcctgaaagcgggaggaggaaggcgcccgccttaggtacagtgcttgttcaaatctaaggtaacacagccaaagaaatcttgggggacatgggctctaccacgagggcccacgaccaaggtttcatgcgcgtccgtgtgaagagaccaccaaacaggatttgtgtgagcaacatggctgtttatttcacctgggtgcaggcgggctgagtccaaaaagacagtcagcgaagggagataggggtggggccgttttataggatttgggaaggtaatggaaaattacagtcaaagggggttgttctctggtgggcaggggtggggggtcacaaggtgctcagtgggggagcttctgagccaggagaaggaaattcacagggttaatcacttagttaaggttgggcaggaacaaatcacgatggtggaatgtcatcagttaaggtggggcagggccttttcac

SEQ ID NO: 457 - DNA, 50 bp, Homo sapiens
cgcctgatctgcaaccagtggcaaatgcagatcccagatgcactctggaa

SEQ ID NO: 458 - DNA, 1024 bp, Homo sapiens
actctgcagaattgaatacctgagctcaaaggatcctccagcttcagcctcccaagtagctgggactacaggcacggtcaccacgcccagctaatttttgttcattttatatagagacgaggtctcaccatgttgcccaaactggtcttaaacgcctggactcaagcaatcctcccaccttggcctcccaaagtgttaggattataggtgtgagccatggcctcaagcctggagtcttctttaatggccagttctcctcctcttttttcttgatgtcctcaggccccgaagcacacgatgtcagtccccagtgcacctttgtcgaatgacttcacaaagccacctctcatttccctggatgtggaaggacaaatgccctctgcctcctgccctgcccctgtcataccaagcgcccaaggccccagccccactcacctgagaggctgagaaggagcagagcagggggcagccacatggctctgccttcccggctcctcgtccgcctgatctgcaaccagtggcaaatgcagatcccagatgcactctggaagttctgcctgagctctggcttgcaccttctgcacatctagaccgcctttgactttcttactcattcacttccttttatagagtgggtagttcctgcttttaattattaaacgaaagaggtgtcattttttggcagggctgcgccacagggcttaagcatcgtcactatgtaaaaaagaggagggaggggactgtgcagggtctttagggtagggggagatacgtctgcagaaggggtggggtggggggcgtctggcctagcaggccttgggtccaaggggtataacactctgggagtcaatttcagagctgttctataccacagtgaacacccaactcagatgtcggatgggtcatgctgggcacacctgaacatgcatttgttcaggtgttatagccaagtgcataaacatgcagactgttgggtcagacagacctggctctaaccccacgagcaccacctacaagctgcgtg

SEQ ID NO: 459 - DNA, 50 bp, Homo sapiens
cgggctccaggctgaacggctcgggccacttacacaccactgcctgataa

SEQ ID NO: 460 - DNA, 1024 bp, Homo sapiens
ttatcctttcaagctttcaaatcagagcaagggaaaggtcgatgctagagtttctctagcacccatgaagccctctccctttttctactgagttttactttacaggcaacagcaggcttcaagcttggggtcattgtcgggcaacagtatctggcaagaattcaatgtctttttctcatagtcattgtattttggcctctttctatttatggcaactgagagagaaagcttattcctagatatatgtatttaagtaaaaaataaatgaattcatggaaacatattaagcaattatccagataacataagggatggcaaaaatggtgcagatggtggaggggagacaagtagaagttggggtgctcttgttgaatgtctggctctgaactctagaggaggccgcaggggctgggcaggaaggaggtgaatctctggggccaggaagaccctgctgcccggaagagcctcatgttccgtgggggctgggcggacatacatatacgggctccaggctgaacggctcgggccacttacacaccactgcctgataaccatgctggctgccacagtcctgaccctggccctgctgggcaatgcccatgcctgctccaaaggcacctcgcacgaggcaggcatcgtgtgccgcatcaccaagcctgccctcctggtgtgtaagtatcagtgcatctgtctgccctgccaggggtcttttcatggacacccactatgccaggagcctccctggcctgaagccagccctgaagccggctgccacactagcccagagagaggagtgccctgggagggagatgggctgagtggagctgtcatcaccccctcctgacctcgccttcaaggtcaagttctttggtgagaaggtcctagctgcattgcaaacagccaggtatagggatttgtgtttgtctgagacccagaatcactggggttcgagttagggttcagatctgagccaggttagggggttgagtcagggggtaaagattaggaggttggtgtatatttg

SEQ ID NO: 461 - DNA, 50 bp, Homo sapiens
cgcagcctaagccaggcacacttgcccatgccctggaatggagagccagt

SEQ ID NO: 462 - DNA, 1024 bp, Homo sapiens
acatacatctgttgaagtgttaaaaccagattgaggccgggcgtggtggcacatgcctgtaatcccagcactttgggaggccgaggtgggcggatcacgaggtcaggagatcaagaccatcctgactaacacagtgaaaccccgtctctactaaaaaaaatacaaaaaaattagctgggcatggcaacatgcacctgtagtcccagctacttgggaggctgaggcaggagaatggtgtgaacccgggaggcggagcttgcagcgagccaagatcgtgccactgcactccagcctgggcgacagagcgagactctgtctcaaaaaaaaaaaaaaaaaaaaaaacaaaacagactgagaataactttctgttaatgagaaaatatatcatgagcagatgccaagggcacagacatcatatcatggtggggagatttttcataattttcagtggtgcagatgacgctcttcccatgtctggggaattgcctgcccagagtctgggagagacacaaggcctgggagccgctttcctggcctgccgtgcagctgaggcactggcacgcagcctaagccaggcacacttgcccatgccctggaatggagagccagtgacccagagtagtggggatgtgagcttctccttctctgggggtggagcaatggcagtgagaccaaggggctggggcagtggttgagcgatgctgacaacagggctgatggcacctagtgtttggcagtggcagtagcatcctcttcagacctgtttatggtgtgatttgaggcattcttcctggctgtggaccccacacaagattcactagccctcccagtgactctaggatctaccttcaaatgtttgcataaatttccttttaagtcagcctgagtctgtttctgctgctttacaaagaagacccttactgaatcaccactaagtgctgggggagaggacacagaggacagagggcccacatatttgtttctcaacacattaaaagggggtctttgggccaggcatggtggc

SEQ ID NO: 463 - DNA, 50 bp, Homo sapiens
cggatgttaagtggattgttcagggttattctgttagcagtgaaggtgga

SEQ ID NO: 464 - DNA, 1024 bp, Homo sapiens
aaggcagagccaggaaagggggaaaaaagcagagtcctgtcaaacaaggaggatggagctccagacacaaggaggccctagcaacactgagctcagttctccatcaccacggaagttgaacaagatgacaggggctaaagtaagggtgaaggagggattattggaaggtgtcacagtctgaaactagtagttagggtatctcctttcccagagaattggagaaaaaaacctgctattagtaaagacacagaagtggggtgacctttagggtagtggaaaactggctgtcttcagggacagggtcccaagagtagcttggctccttccctcctttgttccccagtctaccaggtgtgtctcattgtttccttttcctctagattcttgtgtcattagcttggagttgaagggaaagcattcaaggagctcagggaagtgtttagcaggaggcctggagttcttgatccagtcatatcaaagccacatatttttagttctgaaagggaagaaaaactaacagagatgggtcattttagtccagctgactcattttaagaaagcggatgttaagtggattgttcagggttattctgttagcagtgaaggtggaactaaagctcaaatccaaagcctaagggtgtatgttagttatttgtaagagatactgataagaaaagatgtctcacaaatacagtaagatctggagcatactaaatagaagacttggcgtttttaattcctggtctctacttttcctaccttttttaggtctggttctccctttgggtttatagtatgtgaaggggactgttttctgttttaggagttcctggattgaaagggcacggagtaacaggcctcattacagatatggatcccagaagactgagaggggtgtagaggtgcacaggcaagaaaggagtatgactattggaggagagagagagagagagaaaagaaagaaagagcaagaaagctgggagcgctgaggtcatctccaggtgtccttttgttagtaaggtgt

SEQ ID NO: 465 - DNA, 50 bp, Homo sapiens
ttccatatatcataaacagagaccagtattacaatacttcacccactgcg

SEQ ID NO: 466 - DNA, 1024 bp, Homo sapiens
agctgaaggcgggggcctaggaggaggccgcagagctgtgatgaagggctgctcatcagaggcacatgcacgggtcagataaagaagctccgctgcgaagacagggggcaatgcaaggccacagccgaagattccatgcatgctcttcacggtggcaaattcaaaagccttggagggcagcatgcttctatgataatagggaatgggggccggggggaatatgtagaccccatatcaatgctctcaaaacctctctctctctctctctctctgtctctctccctccctctctcttgctcactctctctctctctctctctctctctctgtctctctccctccctctctcttgctcactctctctctctctctttgtcgtgctctctctctccctctctctcccactccccacctctggcctaatatacctgcatgtccacagaggcaccaatctgcaatgatgatggactctctcacccaccctgctactaggaaacttcttccatatatcataaacagagaccagtattacaatacttcacccactgcgccaatttggctttcatgtctgtttcctgtgtcgatcacaacatcctagacagcccaaacaaggctttattcacctctagtccccggtccctggaacagcagacaataaataaggaatcaacaagtgtccttcactgccgcacacattggctgtgaatatccttttgcaaagtgcagaacatctgaaagattctcacattgactaaacaacagtgtgacctgaagttaagagaaccataaaggtaaatgattgctagaagtttaattccaaacaaggaagagcaatttgatgcaatgggcagaagacaaacattgggagaatgagaacgtatcctcttgagttgtgatgtgaacaaacagagattccaagatcttgcaaaagcgaacagtcagcaaccagcatggtgcttagagtagtccctgggcaacagaaaaaaaacagataaatgaagaaacatggacaatcaccctacct

SEQ ID NO: 467 - DNA, 50 bp, Homo sapiens
cgcgtgcacagcatgttctttgactaggaggcacacctgctttggttatc

SEQ ID NO: 468 - DNA, 1024 bp, Homo sapiens
ttttgccttgagtttcatttattagagaacccagacattgtcccatatagtctcccagagttggatcttgctagtttcatccccacggcctagtttaacacattcctctgtcctttctattttcttttttttttcttgagagggagtctccgtctgtcccccaggctggagtgcagtggctccgtctcagctcactgcaacctctgcctcccagttcgagcgattcccctgcctcagcctcctgagtagctgggattacaggcgcctgccactacgcccagctaatttttttatatttttagtagagacgggggtttcaccatcctgatcaggctggtctcgaactcccgacctcaggtgatggacccgcctctgcctcacagagtgcaaggattacagacgtgagccaccgcacccggccaaatgtcctttctattttctataaattaacagtcagatctaggggctcgatcagatttgtgtgtgtgtgtgtgccgtgtgcgcgtgcacagcatgttctttgactaggaggcacacctgctttggttatcttctttttgtaatctttaagttgctctttgatgtagacgtggtaactaatgttgaaacaaaattagtttcgtttcaaaacctttctttcaggaagaggttgtggttgattacttctgcgacaggtagatgcaaggttgagcaatcatctcttaacagaagtggtcacactagaataattcaagcacaacaacaaatcccacatcatcaccccctcttaataatggtgttttctttttacttgattagcttttaattgtcacgcactctgcattttttccctgaggtattatttccagaaggcagcgaaatatgactcaatggctaatttgctttttaaaaattaaacaaaacttaggccagctgccatttaagaagggctccggggcctccagactcggtgtgaccgtagccgtgcccggtgctcccctcgcggaggcgttagggcggcaggtttatctcacttgagaccatt

SEQ ID NO: 469 - DNA, 50 bp, Homo sapiens
tccaaacgacaagccaagaagacctgttgaaagtttcctcttaagtttcg

SEQ ID NO: 470 - DNA, 1024 bp, Homo sapiens
tctctactaaaaatacaaaaattagccaggcgtgctggtgcaagcctgtaatcccagaaactcaggaggctgagatatgagaatcgcttgaacccaggaggcggaggttgcagtgcgccaagatcgcaccactgcactccagcctgggcaacagagtgaaactctgtctcaaaaaaaaaaaaaagattaaatatgtgtacagtacctgtaccatgttaggcggtcagtaaacatttgtttaactaacaactgataaggatagtaaagaagtatcagaacacccacctagttatcccaaagggcaggaagagtgctaggtaatggatatagaattccttttagagtcaaattacacgggcaaagatcagcccctccttcaattaaaaagccaggggcagggcgtaataaggaagtggttctccttctttaagcctcttttcaggctgagtcctaaacctgaagaaagtttagagcctggggctctaaactacctgagtctttccaaacgacaagccaagaagacctgttgaaagtttcctcttaagtttcgtggagagagactcaggtatagaaatatccttactgccacctgacctgaagcagaagaaatcacagacagcttccagaccaggtaacaccaggaggcaccagtcttcatcctcagcctttgcaggaggacacagcctggtctttagctgtttgccaaatgaggcagtctaattcagggagctctttactgggtttattacaaagttcttatcatgtaagtctcaggacacaaaatgacattgagaatctagtttagcggggtttccaggaaagacgaagaaaggttatttaggtttctctttcatttctcttttgctacaaagggtttgggacattcagttaagaacacattactggttgaggtatgtgacgttactcagtcttctctgcttatgtatctggggaggtatgcaatgacatgacagccattccgtggccagggacaccactgcccaagctggagaccacgaggatt

SEQ ID NO: 471 - DNA, 50 bp, Homo sapiens
cgagcgcccgtgtctaagacaccaattgttcctgactgcactgctcctgc

SEQ ID NO: 472 - DNA, 1024 bp, Homo sapiens
cgggggagaccagcctgggcggggagatcagcctgggggaggagaccagcctggtgaggagaccagcctgggggaggagaccagcttgcgggggagaccagcctgcgggggagaccagcctgggcggggagatcagcctgggggaggagaccagcctggtgaggagaccagcctgggggaggagaccagcttgcgggggagaccagcctgcgggggagaccagcctgggcggggagatcagcctgggggaggagaccagcctggtgaggagaccagcctgggggaggagaccagccttgtgggggagaccagcctgggggaggagaccagtcttgcgggggagaccagcctagggtggggagaccagcctgaggcagccccacgatggcccccacatgctttggagcactgggtggccctgagggctgggctggaggccacctactgacctcactccctgatgagaagggtccagcagtgcatgtccacccctcagaccacgagcgcccgtgtctaagacaccaattgttcctgactgcactgctcctgcctgcacgtaactgaggacgcccccaacccatggccacggcccctcgggccgtcacacagggctgcggctcatggggccctgctagagcaggcgtctgtcctcagtcagtgcgaccgacttgaaacccaccctgactccctgcttcaattacttgggaaagtaaatcacctcagtgttgtttcttggctccgagggtcttgttttatcagcagccgggatgcaacagatgggtcatctcatcctcatgggaagggacgtacggcagaaagcacaacccagtgggccggccacacctccagccctgtgacgggcacccaccaccaccaacccagtgggccggccacacctccagccctgtgacgggcacccaccaccaccaacccagtgggccggccacacctccagccctgtgacgggcacccaccaccaccaacccagtgggccggccacacctccagccctgtgacgggcacc

SEQ ID NO: 473 - DNA, 50 bp, Homo sapiens
ctaccattcattaataactgcacaaggccataaagagtagccatagaacg

SEQ ID NO: 474 - DNA, 1024 bp, Homo sapiens
ctatttttatcagcaaaaattcttgagtttgggggcaacaggcaattctcttctttcatgggtaaagaagaagaaaagcagctactgttcatcttagcccattataatatgccacaatttcagtgtgttaggggtttccaatctaaaactttcttacctcctgccagttttatttaccagaataaaagtcacattggtttacttcagaatagattcggttttatttagttttaatttttgtgttttaaagttcctgaactcatcattattcatggtgtgaataatcccaatgctaaaccgtaatttaattatcagaaaatgactttgatttttccataaagcatatatctacaactataactatgattatcttaacctgttctcttgttctaattggcatatttaaagagataaagtccagggcaagtgagcaatgtcttccccacccagactattttcttagaatagaaacacatattttattcctcttatgacaggtactaccattcattaataactgcacaaggccataaagagtagccatagaacgccttgtttaagtgtactttcccttatgtaatactgccttacattgcataacttcacctgggtgacataacaaagtttgcaacacttttgattgtttccataaggaatacatgtatatgtatatgtacacagagagagtatatatatgttaggctttatatacatctgcacctaaaagttatttttagaaggtctatatcaacatataagagaagtgtcttaagaatcatctgagtcagagggtagaaggttgatctgttaggaactctctctatgaatatcagatgcatgtgcctagtgactaatttgtctgtcatgaatttcacatttttcttaatagttctcaaaatgataaaatgtcttttgtttacaacatgaatttaatttgattcaccttggcaaatggcctgttcaggtagttaacatttacaactctaggcatctttactcatttatatcttcttaaagattaact

SEQ ID NO: 475 - DNA, 50 bp, Homo sapiens
cggcagcctgcgattctcaaccaggggaactctcactgtgctttctgaga

SEQ ID NO: 476 - DNA, 1024 bp, Homo sapiens
gctgtgatcttgcatttgtttagcgctttgttctccttgaggcagtaaagtggtggcacctgaccggagcatgtagccacctatgacttcctgagtggggtggtgtggggagggccctgaggagtctgtggtcctaggccttggatttcatcagggctttcctgctccttctggttgcctcagtcccaggcaagatagggtcccagaatcttacagcccagaggccacctgttgcaacttcttttttacagatggagtcatcagaacccactgtgaggaagtgacttctccttgaggtcacccagacactccaaacagagcagagcaaaagcgcctagaacttgaaattttggacctgtctccaacaccctggggatttccaccaggaaggtgagcacccccactgagaattccaggctgctcagaggtgccagggaacacagaccagggaccagctgtggccccctcctccgatgtgcccagggaagtgggggaagccagcggcagcctgcgattctcaaccaggggaactctcactgtgctttctgagagtctgtgacacgggtcattttctctgacttgctctcttgctttttctcactctaaaaaaaaaaaaaaatgactggacactcctaaagccttcagtcaccatccaggggatttttatcgccacaaagggtaattcctgctccatccctgctgtgactcagctgtgacgttgaaccacacaagccagagagaagaagataaagtcatcagagctcctactcaccagagagtgaggcccaggccaggactccacaaggctggtcccctgccctggagcaacttaaacaggccctctggccagcctggaaccctgagatggcctccagctcaggcagcagtcctcgcccggcccctgatgagaatgagtttccctttgggtgccctcccaccgtctgccaggacccaaaggagcccagggctctctgctgtgcaggctgtctctctgagaacccgaggtgaggtgatggaggagcgg

SEQ ID NO: 477 - DNA, 50 bp, Homo sapiens
caggttctggatcccacctgcaagttgggaattttcaaactgcaaagacg

SEQ ID NO: 478 - DNA, 1024 bp, Homo sapiens
gtgaaacctgctggccctgaatccctaagcctcacagcacctcacttctccttgctgggaacctgatgactcaggggacccctggtccttgtgggcctctgttggctgtacctgaagcagcaggagcaaagaacccctagtaaaaggcaggaacttgaactccatgtcagccaggatctgcctactgcaatcatcttcttttcttagctcccggagctttctctcagtggacagaactgccctccagctttcctgagctctttccacacaggcaagaatctccttctgatagaaggaagtgattctttccaattctttgctgatattttcagccatctccttgtagaggctgtgaatctgctgtgtgtattcacatttctacacacgctcagaagtttcttcttcatttctaacctgtgtgtttccaccgcaggtgatcttctctgaagttgcgctatgtgttcttgatgtgattcaggtaggatttgaagcttcagctgcaggttctggatcccacctgcaagttgggaattttcaaactgcaaagacgctttctcagtttggagatgtttgatttgtcctgtgagctcttcattcattgattttttttcccacaattgtcaagctatttcttgatttttcttgactttcacagaacacatttaagtcaccatcacccaggacgctcttcagatggccttctgactgatagttgggcgggaggggctggggcaggcagtcttcattttctgctttcctctttagctgtactttcgagtcctcgtcactgtggtccctagagaaatctcccaactgcatggtgtccagcaggttttcagccatagattttaattggctcatggtatctttcatgacctgttttatttgtgcattcaaaggtttccagcttttctttctctccttcctttcctgtactgtctgcttccatcttgcaatttcttggtcgagcacttctggactttctgctaaatgagtgttttcattcaaactgttatttccttct

SEQ ID NO: 479 - DNA, 50 bp, Homo sapiens
cgtggcaataactagaataagagtaataggtgacattaatccatgttact

SEQ ID NO: 480 - DNA, 1024 bp, Homo sapiens
gccatagaactaaaatacatttttaaattaacttgcacagtaaactaggaattcagccaaagggaactgaaaatttagatttatagtaatcaggaagttgatccttgaacaagatagagttggctcttggacaggaaagctatctccttgaccatatggatttccactggccttacagaaatacttgtgctttgatctggcataggtatctttttccaactagctggactctattttctgaacctaacacccaaggattttcagtatagatagaaaatctgactaaacatgtaactacctaaattggtttactgaaattttgatagactctgcccatgtagataatccttggctactgagttgataatgaagttttaaatcacttatctgcgggaccctggacacagggctgtctttaaactcttccactgagttccaatggcctcattagtttcattgaccttcacagatattataaatttggaaagccagtgggagaacgtggcaataactagaataagagtaataggtgacattaatccatgttactatgtgatggatgttaccatgagccctgcacccagattaccttaattaacctcatagcaatgttgtgtcaaatgtactgagttatcaccacattgcatatgaggaaaatgaaacttagaggggtaaaataaatttcccaaggttacacagctatgaaagctgagtagggatttgattttagagcatgtgtaacaacctgtacctgaccatttcctgaaaatagggctactgcaaaaaccaggagtggaactcatctaattccaatgaatgatctacctatgactctctagacaagtcacagaatttacccagtgctcagttcactcttctgtaaaatgaagatgttggatttcatgtcctacagggcctctctgagctctcaaattacatgcccataaaatatactagttgtaaactattagtagaaggagctttaaaatcactgtagggagtccaagatttgccactaactttt

SEQ ID NO: 481 - DNA, 50 bp, Homo sapiens
ttctctcgagctcctgctgtcaggctaccggggtagttctgacctaaacg

SEQ ID NO: 482 - DNA, 1024 bp, Homo sapiens
ttaaaattgatgtacaaatgaaagctggtgtaatactcgaggcaagcaggggaaagaatggacggtggtcacgccaagaggggtgaagttggagcttccaggttaggcagggcacaccagagttccaggagccaggtatgggggaagtgtggcgtccccagacaggggcacgatgtgctgggaagggtgttggggccgggctggggtgcgtgtcggggctccagctgcagtagcagatgctttgcggcggaagcggggagtcacgggttgacctggggagggagggacccacatatgagcataggtgggtgaaggggacccgggttcacctttcagcgcctctttcatcgcgacgcgttcctctttgctgaactgagaagggattcgcgacgccctttgatgctccccgctcctcgggcccatcgatctggagacggtagggaaaactaggagcagcatagccaccagggccagcacgcaaacgcaccgctgagccatgcttctctcgagctcctgctgtcaggctaccggggtagttctgacctaaacgcccagactagcgtttcttggccctagctctgctcttattccggcaaacagccttagccacaccccatatccagatctgaccaatcatcgcttcgctaggacagcggaacaaccaattgacagaatgaccccgcccaggatccttaaggcctttcgagggttgtgggttttcgtgctgaggccagcagttcctgcagagcagaggtgaggtcgggctccaggctagagtcatgtctggtccgcacttgatctctcacccataaatcctttcctgtatgacaacaaatcaaataaaggaggaaaagcaaaataaaatgcacgaagcttatcagaccatactctgctgctcgttttttccgaagcttagaacctgactacaattccctagatcctggggcgggggagctctctaggttcccagcttgatttcatctgaaattggaacaaattgctctgtttatagatactgctttga

SEQ ID NO: 483 - DNA, 50 bp, Homo sapiens
cgtgcctggcaggggaaaggaaaaactaaaatgattatttcggttctaaa

SEQ ID NO: 484 - DNA, 1024 bp, Homo sapiens
gtatggtcccttagaactggtgtagtgttcccagccaactggctttttatgcatggaacaagccctgcctcaaggaaacaggatccatctgggctgctgtgcctacattccttacctgtcagatgtgattcacccctcttccctcacccacctgttgactcaacttttgtgatgaaacttgtggcacttgctgtctgacaaggatgtcacctgggctttatccccctgaacaccctttgctcccaggtgtagtgtttacaggaagggtggtgtgggctgaaagagagagaaggaagacattctggggctgctggaaccagaaactgtcctatcttctggaagagtctaatcctcagcacaggtgacacttgtagggctgtttaatatatgaagtggatgtagagataaacaataggtatttctggttattctgggaggccaagggcatggtggctaggtgaaaaatagtaatattctgttaatccatcactcagtatactcgtgcctggcaggggaaaggaaaaactaaaatgattatttcggttctaaaaagccttttctccaaggaggaactcagggtaaacaacataggggcaggctgacctcagtctgtgaaggagagttcggagcagtgaaactctgggaagaatggtcacgttcggaagctctggagcaacctggcccttttagtccatccatttattctgtacattgtgacagtaggccctgaagaccctggctatcatggggaatcccttctctgcagccaacatgggaaggaacaaaggagctgggattccctgagcccttatatcaaagttcactctcctcaagataagatgaaacttaggtcactaatccaggtctacctgcagtacacaacctgttgcaagtgtggtttttggaaaatccaaactatccttcaaatccaggtgtcggatggtccctccctcattattttcactcatctaaatgtttgtagagcaactgctggctgcacagctgtgtcacctctcatgaactt

SEQ ID NO: 485 - DNA, 50 bp, Homo sapiens
gccaagttgacccaacatacaaaagcaacaggtttggttctacctggacg

SEQ ID NO: 486 - DNA, 1024 bp, Homo sapiens
tgagaaatccaaccagtctaagcaactagctttaagggccagtgttatcacagtttttcctctaccacaatattttctttctttcctcaataccttcctttccccctagcacccctgagcaaatgcctccaagcctagagtttggtggtttagtagaccgagcctgggtgttgagaggtggcagcactgctgtgtaagaagctcctaagggtggactaggaccttctgcctaaatcagggcagggtggagctcaccaccctgagtcactcacctgtccaggctgcggggagtcacatgcagagtgctggactccaaggtcctccctctgattgtcgaaagggttggagtgacaccatccattgtatcaggaacctttgagatgctctctggcttcagcttctaagtttctcttaatcataatcagttagccagcatgtctaccacttctccccacccccgcaacaaactccctatctcgtgtctacctctgaaacgtcaggccaagttgacccaacatacaaaagcaacaggtttggttctacctggacgtggctaatgcccactgcaggaagtgcgatctcatccggacatggtgcttccaagtgaggtggctcagggagaatctgtggcctctgccttcacgtttctggtggaaacgtgaggggcacagagggggaaactgccaagaggctcaagagaggctccgtgagaagctcgtcttccttcaacacccaaagcagagtgaaaagagcaaaccactttgccagaatggaaacagagagtcagtcaccggaaacgacaccaccaatgtgctaatgaagcacagggcacaggaaactctgctcagctcttaatctgctagaagaaaacatatcttcaacccaccgttcctgggtttgccaggtgctctgtggtctgtgatgagtgtgattaaaaatggggcagggtagtagagaacttgtgattcttcaccctgagtttctgagacacttagagttgtataagtcttcagatttacagtat

SEQ ID NO: 487 - DNA, 50 bp, Homo sapiens
cgggatctgagattgaccctggactagaaactaattctagtagtgacttt

SEQ ID NO: 488 - DNA, 1024 bp, Homo sapiens
attttaggataaaacagcaaaataggaaaaacatgtttcttgctcttatgatgcttcctggtgtagtggaacagaaatgacaatgtagcaattccatgtgagatggtcctttgaaagagctaggtacagtgacagctatggactcttacctctaagctgtggtggaagatgtttgatggacagtacctcttgcacaacatactgattcacccctccacttttcaacaactcctctggggataatggcagatggaactcatacatttggggagccattctactcctacaggctcacagggctagaaaccaaacagtgaaaaagtcagggtctatattcaagacctgtcttcgtatctggttctattactttcccatccccaacatatataatggcttttagttttatagcaagctagtaacatcatctggttttgttagttccccacccccaacatatataatggtttttagttttatagcaagctagtaacattatcttacgggatctgagattgaccctggactagaaactaattctagtagtgactttggcacttggtcttgacacttaaacctctgggctttatctgtaaaaacagggttactaaactctgattacttcacaaagttgctctgatgatcaaacaaatcaagcagtacgaaggtgtttaaagaactataaagtggcatattaatgtgcaaagtactattatttccatttttatgtgcaaagctccttaagtatagagagaatggtctgatctcgtctgaggccaaaacagtgccccagcatgggctagtgggcttcctgcaccagaatggtaagagcattaacaatgatgatttatttatcctgtgccaagtctgttaggctgtttgcatgtatcatatctgatctaagtatcctaacctcaatcccatgaggtgcataataatacaaatgagtttacagagcggaaattgaagtaagaaagttaagcgatttgcttaacatcttccgttgcggatctgttaagcgatttgc

SEQ ID NO: 489 - DNA, 50 bp, Homo sapiens
cgacaccaccaatgtgctaatgaagcacagggcacaggaaactctgctca

SEQ ID NO: 490 - DNA, 1024 bp, Homo sapiens
gcagagtgctggactccaaggtcctccctctgattgtcgaaagggttggagtgacaccatccattgtatcaggaacctttgagatgctctctggcttcagcttctaagtttctcttaatcataatcagttagccagcatgtctaccacttctccccacccccgcaacaaactccctatctcgtgtctacctctgaaacgtcaggccaagttgacccaacatacaaaagcaacaggtttggttctacctggacgtggctaatgcccactgcaggaagtgcgatctcatccggacatggtgcttccaagtgaggtggctcagggagaatctgtggcctctgccttcacgtttctggtggaaacgtgaggggcacagagggggaaactgccaagaggctcaagagaggctccgtgagaagctcgtcttccttcaacacccaaagcagagtgaaaagagcaaaccactttgccagaatggaaacagagagtcagtcaccggaaacgacaccaccaatgtgctaatgaagcacagggcacaggaaactctgctcagctcttaatctgctagaagaaaacatatcttcaacccaccgttcctgggtttgccaggtgctctgtggtctgtgatgagtgtgattaaaaatggggcagggtagtagagaacttgtgattcttcaccctgagtttctgagacacttagagttgtataagtcttcagatttacagtattttctaagcaagtctaaggagcactggaggttgccttttagagtgaaatgcagatctccgggaccctcttctgattcagtgggtggaggctgcagagggggcaggctttggctatcgatgctttccaggtgaatttgatggagctttcaggtgattttgatggagctcatctgtgtttcatgttttgggaacctctgctctgggtactaccttaagaatagaagttatgctgggttagcaggacccctgctcccccaaggcaaccttccacagctcctggctgctggtgatctcctg

SEQ ID NO: 491 - DNA, 50 bp, Homo sapiens
cgtttcagcctcagaaagagataatctgtgaaagccacagagcctgattt

SEQ ID NO: 492 - DNA, 1024 bp, Homo sapiens
tatataactttttaattttgttacataaactgttgttagaagttgaagatggtttccttaatttttattttgcaatctttatggattgaattaaaaaataatttttggacatgctaaatattctgagaggtgtttagaagtagattctatatccttagagagcctctagttcccacagcagcttctccagggaaaagcccttcttcactatattcaccacaaattaatggcagttattcattttttaaagcagtaccagaagctgatcttagcttaaaggggaggcttcatctcacatatgagcagcaaattgattttctcttcatggcactgtatcgatagggttaagtattttgatagaagaccatgctatttaatataagtagattttcaagaaaatcactatgctaaatacttcactagaaggactttatctatatacagcagcaactgtgacctgctttagagatgacatcattgggtgtcatgtggctctttatacgtttcagcctcagaaagagataatctgtgaaagccacagagcctgatttctgctgtgataatcttcagcagaccgaggctggggcgagaatgaggcagacctgtttacatggtgtgtgcagtgccttgtggaattcttaactctattttattgtattatttttaatcgaaaagtagatcagatgatagcatgaagtgaatcggctgctttggactaatgggatcttcttttctgcattaagatcaagaacttttctggaatcctctgttctccgagtagccttgtcttctctgtgtgttttatcaatttgaagaacactggcaaaaatcagcaaacttcatctcccaaaaagctctcgctcttttttgccaatacttgaagatttctgctccaaaatctactttgagctgcttgagcatggtggttgataaccgaagggcaaaagcatcacttatttagtgtgtgttatagaaattttttagacaaccttactagctaacccaggtgaccctttacggattt

SEQ ID NO: 493 - DNA, 50 bp, Homo sapiens
cgtgtaaaaacaccagaccttgttttggggttaaggtgagaaaagggctt

SEQ ID NO: 494 - DNA, 1024 bp, Homo sapiens
aggttaaaatagatgatttagtggaatctcatttttgttacttaaaaaaagcatgtatcatgtatataaaagcatgggtaaggatgtagaaagatacttagtaaggtgttaacagtcatcttttaatgaatggagttataggcttttctctaccttctttattacgtttaagaatttaatgataaaaagtcacgcatgttgtttcaccccagcagtgttggctttactaaaaacacatactctaagaatcccatacatgaaaggtggaacttaatcaagaacatgtcagagagaagctgcttgagcaagaaaatatctgaaaagcaagctctcctagaagagaagcaaggcctccttaacagtttataagcacacacctgttaggggcacatactgcctgccagtgcctttcactctaagtctctctgtaagctgtaaaagcaaacagtttaatggcaaatacatactctatccaggttaaggtgccacagatttataaacgtgtaaaaacaccagaccttgttttggggttaaggtgagaaaagggcttgctaaacagtctctttcctagaaggaagttctcttacccactcactccctgggacagaaggtcaaagagcatctctggttggaatcataatgcttcggcctgaagtgaccaggccactcactactttagttgcccaagcagtatcaaaggagctcacctcatagtctttccttggaagaatctcatcctcctcctcctgtgtttctccaaggatggtctagaaaaacagatccgcagagggagccttttttagtggttaggagtggaaggaggcagaagtatttactgaaatcagtggctagcttctaaatcatctggagccattatcaaataggaaccagccctcaaaaaaaacctttcaggggtgagggaccatgtgggtgaggatctacagccatcagctgagctcttcatttccactgatagtctccaaataaccaccctcctcttcaggacacctcaaagatgtccaac

SEQ ID NO: 495 - DNA, 50 bp, Homo sapiens
cgtgtaatgctcaagttgtgataagtacgatgaagaagtacaaagcagaa

SEQ ID NO: 496 - DNA, 1024 bp, Homo sapiens
tgactgagggggcgccactaggcgcggtcacgtgcattcgcggtgcattcgcgggggcgtcggtgcgggtcgcgtctcttaagacacccagggagacagacgtggggcagaactcatgggctgaagtgagagatggctggggcccaggcgagcgaccgagcagggtccgaacagagccagcgagggaccccgggctgtgcttgaggcccgacgacgcgccatatcccggcagcgccgcagctcaggcctctgcgaatctgtggtccacacgctgataaacttagaggcctctgcactggggcagaaaccgaaaggcatgacccagaccgagaaagatatttgcatactgagaaagtgtgaaacacaattgtcgagactaaaaggagacactgagaggatacgccaatcaggttagttcagatgtttgttgagcacactccatgttcctggggatccacccttatagaagttaccttttagagagaggagacagacaaatacgtgtaatgctcaagttgtgataagtacgatgaagaagtacaaagcagaagggagggcgcggtgtctcacgcctatcatcccagcactttgggaggccgaggcgggcggatcacttgaggtcaggagtttgagaccaggtctctactaaaaatacaaaaattaagtccgggcgaggtggctcacgcctgtaatcctagcactttgggaggccgaggcgggcggatcacgaggtcaggagttcaagaccagcctggccaacatggcgaaaccctgtctctactaaaaatacaaaaattagccgggcgcagtggtgggcgcctgtcatcccagctacttgggaggctgaggcaggaggacaaagcagagagtaagggattagggggtggtgggtcgaaacacatgagagatacatttgcgttcagagacagaccgagattggtacagataggcagaaatgctgacagagcaggtaatgaaatagaaatgcaaagatagagtcactaaaaccaaaacatcgaggttt

SEQ ID NO: 497 - DNA, 50 bp, Homo sapiens
attctccaacggccaggacatcattaggtaagacatttcaaaattcttcg

SEQ ID NO: 498 - DNA, 1024 bp, Homo sapiens
tcctcagcccatgtacatggacaataccatcaccaatacttaagacatgcccagtttcttcaaggtcagcagaggtatcagctccaagaacatgctctttaagaatagaggacatctcagcagtcccagtcttctgaagatgagtgttagaggcatggaggttccttgcagcaatgaaagatgaacccaaagcatttctggagaccagtcctgcccaccgagtgaggtcacgggctacggccgcggagacacacacagacagcatctttgcagtttctccacaggtggtacctccacagccgcagcctctggactgactgggaccgtttcaagcatttttaaatgaaacctgatgttgatgaaatctctgaaagtcaagtcaggtatcttacacaatgctgtaatttcatttcaatccttttcataaagggtaaagtccttgtatatattctttcaatacatgctttatctaagacacaagcactctatcaataaaagttttaatttaaacgaccaaaaaattggtgagagagtgctcagaactgaggataaacatgtaagtagttttttgtcccagatgagcaatgatttatgttgactaaggtgtgctgaattaacttattccattaaagtgtaaagggaagacaggttgataagcataacttttaccttgataaatgttttcaatgatttctattgcatgtagactgaaacacctagcatgtaaattattgcagtagaatctgtctctaagtctcagctgggtctgtgaatttgttctaatttgatagcttcatacaactgatgaagctcaaaaatggcttgactcaagatatttcatacacctttcttttgctctaatttctgctacgacaataacccagctatttcagctgatggcgggaacactgcaactggacaaaaatgacacggatgggtgtagagcctccaaacaataagtatctgattaatgctgttgacacctaagtctacagaggctattctccaacggccaggacatcat

SEQ ID NO: 499 - DNA, 50 bp, Homo sapiens
gtaagtgctggccattattattattactccaatatcttaccaccctaacg

SEQ ID NO: 500 - DNA, 1024 bp, Homo sapiens
ttcttccacttgatccaggttggaagtaaactttcggttcagatccagaagccaccttccaatatcaagaactccagaatgacccaagtctttcataaggtagggagtgatggtcagctccttttctctaggagagaatgaggagaggtgggtggccagggtagctttgaacagacagttttggccaatttatcataaaatgtatcataacatgatgacagcactctatccacgtcaccacaccccatctccacatcaccacgccccatctcctccacatgatttttaaaaatgtttttattttaatttttgtgggtatatagtaggtacatatatttatgggatacatgagatgttttgatgtagatatgcaatgtgtaataatcacatcatggaaaatggggtatttgtcccctcaggcatttatcctttgtgttacatacaataaaatacaattaaattactattgattatagtcaccctgttgtgctatcaaacatgaggtcttattcagtgtacgtttttgtacccattaaccatccccacctctcccctgaccactacccttcccagcctctgataaccatccttttaatctctgtctcccttaattaaattgtttggatttttagatcccataaataagtgagaacatgtgatatttctctttctgtgcctggcttatttcacttagcataatgatctctagttctatccatattcttgcaaatgacaggttctcatccttttttatgactgaatagtattccattgtgtttaagtatcacattttctttattcattcatctgttgatggacacttaggttgtttccaaattttagctcttctgacctctctcctgattaatcagtcaatcagtcagtgcaggaggcagggatccaagtgagtaggtcaagtcaataatgtagtcatagaggaaattgaagcttatgttgcactgaggaagatttgtgtgatataacaggaagaacttccctgcgttagggtggtaagatattggag

SEQ ID NO: 501 - DNA, 50 bp, Homo sapiens
cgtctatgatcatgcccatggctgtctctagttccgtcatggtgctagat

SEQ ID NO: 502 - DNA, 1024 bp, Homo sapiens
atggccggcagccttggaggacagccccgagggctcaagggcttggcaagcttggcaaacttgcaaatggcagccctggattgcattccgcccctgcccccactgcacaggtttgagtcccactctcccaccaggcctgtcacaaatacactggggtcaaccccatgtttcaaggatcaagctgaccacaccctctccctgctcagatgctcccgcctcccctgcctttatgccagggtgggtccgttccttggctgggcttccagggcatttcaggatctgtccctcttgcctctgagccccttgaccgccgaccccaccgcagctctcagccctctgcctgccacgccttccccttcttccccagcccccgctgagtccagcactgccggcctggctcacctgcaggaagcctggtagctccttctccatcagcaccttgagctcccccttggtcagggtctgcgtgctgccctcgctgcccgaatatcgggaaaagacgtctatgatcatgcccatggctgtctctagttccgtcatggtgctagattcagacccaccttcctcctgggggctggcagggccgagaaaatgtcccactggcagcctcttggtgctttataaggcagcctcatattgacacagagggtgggacagtggggttgggacattcaggaagtcctgcccctccccattcatgtgctcagttctgatgaaatgcatcgttgtgatgacgtttctggaacctttcccccagccaaggcccagggtgtgggctgcctccaggcatccacattttacagtgttcacctgtgtctcggcgccatcactgagccacagtggcatcctcattcctggccctccctgggtaagtgggcacggggtgagtgtgtgtggagtgagtggtgactccgtggccctttgtgtcaatatcagagcgtgctggcacccagcgtgctgacacgaggagacatctgagagtgaattcacatgggcgtgtttgtgaacatggatctgccccatc

SEQ ID NO: 503 - DNA, 50 bp, Homo sapiens
cgtctgaagctcaggggacaggccaagactgcagatataaatttaagagt

SEQ ID NO: 504 - DNA, 1024 bp, Homo sapiens
ataagtttttacagttattataaaagtgatgggaagcactgaagggactgaattcaaagaatgacacagtcagtatatttgcttcagtgatcactggggctgctgtgtggacatgaaatggccatgaaggcaagagcaggagtagggatacaggtcagcaggctgtcccaggggccctagtgagagacgtggctgcctgggcttggggtccgatggtagtggggagatggactggagttgatttaggttatatttggaaattagctccaacaaaacttgcaattccatccgatgtgggggcagagggggcagaggcagagacatcaagaataactcaaaattttgacttgagcaagcagctgactgaagctgccatttacagagtgaggtatgggagacttaagaaacagttttgcaatcaagaagcctgttttcaggcacccaagtctgacaggctattaaacactcaagtggagatgtgaagtagacagtaggatagacgtctgaagctcaggggacaggccaagactgcagatataaatttaagagtcgactgcatgtagatgatatttaaagccaagggactgaatgagatcaagggactgaaatcacttagaataggggagatgtggaggaaaagaggaccaggacacagctctggggcgtcccaacatttagagattgagacttggaggggaagccaggcaagaggacaccagccagctgattcttaaaataacaataatcacaaaaatgaatcaatcaactgttgaggaattttttgcatatgtttttctggtaaaattatatgatcatataataaaaaattggtcgattcagatttgactttcacagcacaatcattaacagtgtaattttggcaaaaatagctgaggtctttgttaattttcccaggtgtctctcttacctctttgatattcaaatcattctcatttgaagtatctttttggtccttatcctcatagatttttctctcatctaatgctgctgtttcctcatatgt

SEQ ID NO: 505 - DNA, 50 bp, Homo sapiens
cgggggttgccctaaaccctgcatgttccaagtctccaggcctggccctt

SEQ ID NO: 506 - DNA, 1024 bp, Homo sapiens
agatacttcttcggccaccgcctcggacacggtggagctggtgtccacgtgggagtctcccatgttgatcatgaaactgttaggagacagaaacagcagatgtcagcagagggtagcagggtgcccctgaggctggctggggtgcccacctaaatgctgggccttgcccctggggctgcaggaaatggtcactgcacggggtaggagaaggggctcactcagccaggttcctgccaagacagccacagtcttggactggggctgacataacagacagcccccagtggtgtcagcaccagcccagggtggtcctggggtgcaagctaaggcagcagctgggactgggtccctggaagacagagaaaatgacagccactgactctcagtgtgctggaacatcctctaatcccacaaggacaccgcacggggggcaggcgggaggaagtgcacgcaagagtggaccatttcgcagcaaaccctttccccagctgtgtggctggcgggggttgccctaaaccctgcatgttccaagtctccaggcctggcccttgagtggctcctgatattcacgagccttggactatcctgactggcaagagtgtctctgtattcctaaaaccttgggctatgaaggtagttcctgttaacaatgagatttatggtgaatgcctgctttcctatgcctgggagtcttttttttttttttttaagagacaaagtctggtccctccccctccccctccccctccctctttccacggtctccctctgatgcccagccgaagctggactgtactgctgccatctcggctcactgcaacctccctgcctgattctcctgcctcagcctgccgagtgcctgcgattgcaggcgcgcgccgccacgcctgactggttctcgtatttttttggtggaaacggggtttcgctgtgttggccgggctggtctccagctcctaaccgcgagtgatcctccagcctcggcctcccgaggtgccgggattgcagacggagtctcgttccc

SEQ ID NO: 507 - DNA, 50 bp, Homo sapiens
aaagttgaggaaccttaaagagagccacctacttcacgtgcaaagacacg

SEQ ID NO: 508 - DNA, 1024 bp, Homo sapiens
ccaccgcaccccagaaaacaacctcctacttgttccccttgacagcaaataggcctcaggagcagtgacggcgagtaccagccccgaaggcacccggtgaattatccgacatcatttcaacatctcagccccgggtgcccgggaacacaggagaatgcaggaaccctgccagggtcatagcccgagacgctgtgggagggctcccccggggtgcaggcagcgggcctgggtgggctccacggctcagatggcctggggctaacgcgagctgaaggctggagactccatgacctgccctgccgcacacactagggcccctgagtggtgctcctaaatgggcctggttgatccaggtgacccgccaagcaaatccagtccgggtgggggctgtgccgggactctggccttccatgcccactcggggacaggccccacacacagtgagtgacagcctctttagcccatggggggcgttttgtaaccctgagatgtttcccaataaagttgaggaaccttaaagagagccacctacttcacgtgcaaagacacgtgggcagctcaaggggtgcccttagaactccagctggaagccactgcaccatggaactcacccagggtcgaagctgaaaccccggggcgtgtaaccactggagcgtttcacagaactttgcactctcgtgaccgtatgcttaatttcttgaatctgtaaacattaaaaattacgttaatacttgaagagttttgtcagtctgaaagcatcatgcatggaaggacatgagcagagaggcaccttgaggacaccggataacacacagtgccagtcacagaagcgcaaaggcccagagcagcgaaatccaccgtcgcagggaagcggacagcggggccgagggagaggggatctgtggacatggggaggacggatccacggttgcggagagcaggatggcggggccggggagagggagtgggatttcatgggtgcagaatttcagtttgggagagaagttttggggtggatggtggt

SEQ ID NO: 509 - DNA, 50 bp, Homo sapiens
gcacacctgcggtgggtgggtctgggctgtgggttctgtgagttctgccg

SEQ ID NO: 510 - DNA, 1024 bp, Homo sapiens
acaggcgtgagccaccgcgtccggccggtattagtgttttaaaataaaaaattacatttacagaaaactcttggcagaacttcagataaggtaggacagagctcgggcgggtggggccacacacaccggattcatggggaagaagttatcatcgacggcttcttgtttcctgagtcggttgtgagaaggaaactgcaagagtggggcagagaaccagagtgtcagagcaaaacctcctctatctgcacatcctggggacgaaccgggcagccggagagctgcggccggcccagtcccgctccgcctttgaagggtaaaacccaaggcggggccttggttctggcagaagggacgctatgaccgcagaattcctctccctgctttgcctcggtgagtctccaggactgggacgaatgggcttgggctggtgagaaaaactcatgtgggagtggcagtccaggtggaaatgcggtgtgtggaagtaatgacttccaggtgttgcacacctgcggtgggtgggtctgggctgtgggttctgtgagttctgccgcccacatgcaagcgaggaggaggccgcgctgcagagacacggggacagactccgctgggaaaggcagagctgctgtggggtctccgagtctgcagccgctaaataccgcagtactgccatcatcctccgtcggaatagaggagggctgggcttagggatctacagggtgcaaggctgtgggcaaaaagacaattttcttctctctctctcttatttatttatttatgtatgtatgcatttatttatgagacagagtctcactctgtagcccaggctggagtgcaatggcgtgatctgggctcactgcaacctccgtctcccaggttcaagcgattctcctgcctcagcctcccgagtaggtgggactacaggtgcaggccaccacacccggctgacttttgtattttaagtagagacggggtttcaccatgttggtcaggctggtctcgagcccctgacctcaggtgatccgcc

SEQ ID NO: 511 - DNA, 50 bp, Homo sapiens
agacagcgattgttacccaataagcagtagtcacacacttctaccaatcg

SEQ ID NO: 512 - DNA, 1024 bp, Homo sapiens
tccagcaccgcctctccccacaaagttcaattaacacggtaaaaatgaatgtatgtttgcccagaaattattattttataacacaattgatttttgaaaactttattttcaaactaacattttttccaaatttgagtattatatttgttttaaaaaatccttataaaagcagtttcagttctgatgtggattgcaaatcataaaacaacttgctgatgaagcttagatttctagaatgctttatctttagttttcaagttaactttgaggttttattttctgtttgtcaagtcaagcctcttgtgacctttctccctgaatgagcagagttagctatctgaaatgtcaggagtttgtaccaccaagggtaaatttgctggaaagcttttagttgggctgcactggcttgtttaaatagccaaacacctgctaggcaagccctgcgcatgtgagtggctatatatgttccttcctttaggatttgcaaggctggagcacaaagacagcgattgttacccaataagcagtagtcacacacttctaccaatcgccttaggagggctggttaccatggaatccaccatctgttcactccccaccggaatgtgattatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggtaagtaaccctagtaatatgtatccagtttgtagtacgtttgtgtgggggcattatctccatgtggtccaaggaaagtgagctctaagctctttttaaagaaacctccagcgtcatacacttctcttgtattgattttatgcagttcaataatgcctatgcaattacatgttgattttggaaaatgaaaaaaaatttaatcttttaaactgttttctgcttgtgaaattgttttat

SEQ ID NO: 513 - DNA, 50 bp, Homo sapiens
gagcgcctggggctgtccacagtgagcagattcagcagaattgcagaacg

SEQ ID NO: 514 - DNA, 1024 bp, Homo sapiens
agcactttaggaggccaaggcgggcagatcacctgaggtcaggagttcacgactagcctggccagcatggtgaaaccccatctctattaaaagtacaaaaattagctgggcatggtggtgggcatctgtaatcccagctacccgggaggctgaggcaggagaactgcttgaacccgggaggcggaggttgcagtgagcagagatcacaccactgtactccagcctgggcaacagagcgagactccatctcaaaaaaaaaaaaaaaaagatttctgactgaatttaaaaataaacaaaaactacaccaacaccgagccattcacagcctctcaggatttggaaaacaaaacaaaacaaaacaaaataacactgaggcaaagagcaagtcccccacactgtaaaggtatcagctccaccatctggtctcatcagggcctcaccagatgaagcctacccctagcaagctggtctggagctgcagttgggcccaagggctgggtgagcgcctggggctgtccacagtgagcagattcagcagaattgcagaacgtggccacccggctgactgaggaaggccctgtcccgtgggcataaagccaggattcctttggccttttgctgctggaggaaaactaggctgattcagaaggtctcaccactgctccctagcactgactaaagtccgggatgtcagactatgaggtcatatatcacaagtctctgtacgcctttgatccccagtttccacatcaataaaatggcggtaatcatatctgacgattgggcgggattctatgaaataatgcgcacaaagctctggcaaaaccctatgtaatggaagatgttactgatgaccagcactcaagtccttcctccagcctccgcatggaaagttcccaagtgtccctagaagtctggaacactctaatgttgactggaaagaataagatggatctctttttctgatatggaagcgtcccaaatccagtcataccagctgggaggcagtgcccgctagcggtaa

SEQ ID NO: 515 - DNA, 50 bp, Homo sapiens
cgtccccagcagtcaccagaggtccggacagacgttcctagcagggattc

SEQ ID NO: 516 - DNA, 1024 bp, Homo sapiens
tctcacaccatgtagaaacatcaactcagaatgaattgaaaacctaaatgtaacaactgaaaccataaactactagaagtgtatagaaggataaagcttttgacattgatgtaggtaatgatttcttggctatgacaccaaaggcacaggcaataaaagggaaaatagacaagtgtggcttcatttaacgctaaagcatctgcacagcaaaggaaacaatcaaccgagtgaaaagataacccagaaaatgagagaaaatatttgcaaaacctacatggccgaaggggcaaatatctgaatacataaggaattccaacaactcaatagcaaaaatcaaacaacctgattgaaaaacagaccaaggacctaaataggtttctctcaaaagaatgttccaaagacctgtgatagtctctactggacatgtcaaccaggacatgtgacatgtgtgtttagaaggaaactgcttgagtttctctattaagttagctggaagccatcgtccccagcagtcaccagaggtccggacagacgttcctagcagggattcgcccgctggttccctctggggtggccccacagtcagaggtcagattggaggcatagcttcaataatgaaaactcagtgtaaagtttaagttttgtagtacttacagatcctctagctaggcagggtgaccagagagggcagacagcagtcctctgtcccaggtcttctatagcaaggagcagccgtgcacaagtggacttcccctatttaaaggtcttttgggatgaggtgtcctaatttccggggttactttctgttgggtccattaaataattgtggtggcaaggacagttgagaaatttggtgggaaggtgaggttaaagtagaactccacagaggaacctctcatctaccttggtcagccctggccaggcccaggcagcaaccaactatggattctcaatggctcctaacacagttgaccctgtgatgcattggctgtggctaagctgaactacctgcaccaagggaata

SEQ ID NO: 517 - DNA, 50 bp, Homo sapiens
cggccctgaaatcatgcccctaggtctcctgtggctgggcctagccctgt

SEQ ID NO: 518 - DNA, 1024 bp, Homo sapiens
cccacccttccctgacccttaaaagaaccaggaaacagcacatgatctgttggaaggaggcattcattctttcctttctgtgggtgtggggaggggaccacagggcacataccccaccctgggatccagctgagcaggggggtcagagatgacagctcttccggctcacaggccaccggcccacatacagggcaatcagaagaaagaaacagcacaaggaaggcacagagggagtcgttgtccctgccagaggtgcagcactccgggaatgtccctcactctccccgtccctctgtcttgcccaatcctgaccaggtgcagaaatcttgccaagtgtttccgcaggagttgctggcaattgcctcacattcctggccttggcaaagaatgaatcaacccaccctagatcccataaatagggccacccaggtgagcctctcactcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaagtaaggggccaagaggggcacctgcaggcagggcctggggaagagtgggagcagaggggaggagaggtgaagagactcaggaagagcgttgggcaggactctaggagtccagggtccaggtttcagctcactctgtgccaccagggtcccctggtggaaaccatgccccttccccccatccccaccccctctcagcctgaacagactcccccaggtccacatcccctctcccataacccccattgtccaaagaaggtgggagcacttttagtccccctgcacagatgaggaaactgaggctcaggaaggcccaccagccacatgcctcctccagtgaggaggtcaccctcctccctgccagactcagaaccgc

SEQ ID NO: 519 - DNA, 50 bp, Homo sapiens
cgggacaacatcacaggcagagtttactctgtgggaagcacctatatatg

SEQ ID NO: 520 - DNA, 1024 bp, Homo sapiens
catacttggtgatgacacttcgggaagacctggctccaggaagcacgaccctgaaagtgtgggccaaggaagccagaggcagggactaccagaggtgacacactgtcctgtcacctgactccttgtcttgctaccaatctgctcctctgcttggcatcccacacatcacttccccagctatgtctgtctgtcctcctgcaggagggctctggcagctggcaggaggggatctgagggcaggtggaacatgggaggacctggatcaggagctgacctagccaagatccatcatgcaagacacagaggcacacggaagtagtagaaacttgaaggttctttattgatttatttattaacccgttttccagaaggttgcttgggcccgagagtcacctgcagaggcgcaaagcctcctcgacattctttatggggctgagctcatcagccaggaccatcaggtcagtcaccagggtgtccagcagcccacggacctggaagaacgggacaacatcacaggcagagtttactctgtgggaagcacctatatatgaactatgctgtgagagaatagctggagaggggaaagaaaccagttgtttgtgaaagaatttcacaagttcaaagttcttgtgaaataatttttggttttgcagattttttttttttttgacaggatctcactctgtcacccaggctggagtccagtggtgtgatcatggctcactgcagccttgacttccctggctcaggtgattctcccatctcagcctcccaagtagctgggactacaggcgtgcaccaccagacctggctacttttttctattttttgtagagatggggtttcaccacattgcccaggctagtctcgaactcctgggctcaagcaatccacctgcttttgcagttttacttttcaaaccagtctggggaggtggccctgcgctggtacctttgacatatggagatactagagctaagttgttcaaggggcaactccagggagcccatggagcggtgcccat

SEQ ID NO: 521 - DNA, 50 bp, Homo sapiens
cggccctcaaggggtgaccaaggaagttgctccacttggctttccacaaa

SEQ ID NO: 522 - DNA, 1024 bp, Homo sapiens
gaggcgggtggatcacgaggtcaggagatcgagaccatcctggctaacatggtgaaaccccgtctctactaaaaagacaaaaaattagctgggcgtggtggtgggctcctgtagtcccagctactcgggaggctgaggcaggagaatggcgtgaacccgggaggcggagcttgcagtgagcggagattgcgccactgcactccagcctgggcgacagagcgagactccgtctcaaaaaaaaaaaaaaaaaaaagaaaattaaaagtgggtattgttgtaagatgctgagtttatggtagtttgttacatgacaatagaaaatgaacacacttcacagtggactccaagatccccatgatctttgatctccttaacctcctgatctccacaggacccagagcataagaatgtcccttcttctgcttccagtcccactatctagaaaagagaggaggagcccagctcttcatttcacccccacccacaaactcccaactttccggccctcaaggggtgaccaaggaagttgctccacttggctttccacaaacagcctgtgccccaccaggctcaggagggcagcttgaccaatctctatttccaagacctttggccagtcctattgatctggactcctggataggcagctggaccaacggacggatgccatgagggctctgctgctcctggggttcctgctggtgagcttggagtcaacactttcggtgagtgctgtgggaaccaggattgtcccaggattgttctggggggtcgctatcacagccatgagccatggcctctgctcatgacctgtgggtccaggtgactaggaggcctatgtggaaaggtgaggccagcccggaaggcccaggcagaggagacagacaaccagactgggtggatacaagggcacagcctgcatttctgggggagatgggccttaagaagacaacggggggaggtagaaagggtttgggtcttgggaagaaatctctgcatttctgggctgtgagaggaagctgca

SEQ ID NO: 523 - DNA, 50 bp, Homo sapiens
tattactgctgtgaatgagttccggaagctgcagtctcactggtccttcg

SEQ ID NO: 524 - DNA, 1024 bp, Homo sapiens
actgactgtttcataggtatctttgcttaaatgtcacctcctcagataggatcaagtttaaatcaactcaatttaaacacattgaaccctgcttgaagttagaaactgcaatggactgaatgtttatgtctccctaaaattcatatgttgaaatcctaactcccagggtgatattaggagatgattaggtcatgagggcaaagcccttatgaatgggattagtgccctcacaaaagagaccccagggagctcaatggccccttcttccatgtgaggacactgccagaagttagcagtctgcaaccagaagagggccctcaccagaacctaaccatgctggcacccagatctcagacttccaggatccagaactctgagaaataaatttattgtttacaagtcattcagtctttggtaatttcttatggcagcccaaaaggactgagacaggcactgtggtagatgtagcaacaacagttgagtaagatactagacataactattactgctgtgaatgagttccggaagctgcagtctcactggtccttcgggtcatcatccagctttcagttaggggaagctggcaggtaaggtgaaaacagaactggattcaaatcctgactttgtcacttagtacagctatattattttggataaattgcttaacctttgaacttcaacttccatatctatagaatggggataataatatctatctcaccgaatcattataaggattagttgagttaatatatgtaaaaatgctttaaacagtgtggagccctatactaggttatcaaaatagttagtttctctttaaaaaaatggacacatataaatccatcatttaaaaaactctccaaagatctgcttccttaagcacttaaataaaccttcttaaagtttaattattggaacatttcttccttagctctcacttaaaactcttcaggttggatcataaatctattttctcttatttaattctccagcaaggcacaacaggtagttgatagtctctata

SEQ ID NO: 525 - DNA, 50 bp, Homo sapiens
accacacatggggatatagacgcaacagagggcccagttaattgctctcg

SEQ ID NO: 526 - DNA, 1024 bp, Homo sapiens
acagccgtgcagggaagaattaagtctgtttcttaacaccagggcttcacatgtgccagaagttagaaaatattagggacttgccgtgagtttcgatcttctcagctcaggccctagtagaataaggaaggtgtaaagctggagaagagaaagtgcagaggtgttagggacaaaaactcagccctcgactgtccataaggagagtggcctttcagtggacacgatcctcatcagtcgggaatgctgctgaaggggagatgcaaatgtagagaacttgaattcctacagatgagcatttcgaacccacaacatgtttattgttagatactagttggcacaacatgaatatacgctttccaaaaggtagaaagtatctcctttacacaatcattcagtaaggcttcattgagcacctgcttgggacatagtccgtttccttctgcttagttcacacctgtcatgtcttcctgtgatgagcaaacactgagcaagtgtcaagcaccacacatggggatatagacgcaacagagggcccagttaattgctctcgctcttttggagagaattacagtgcacagtgggaaatattggagagatactttggaataataggagactattactttgaagtcagacctgaagtccattatctacttgaccaattagtaggacaacaatctcactgaacccgttttctcatatggaaataagataaaacttgaagagtgaacatcgcggtaggtgctttgtaaataatagctaatctaagaacgcaggcaggcattgcactgagcactgtgaaagtatggaaaagggatttctgacagattgaggaaaaaaggatacctcgtggatcctgaaaaatgtgatgcctgagctgagtcctaaagaatgagtaggagttaaagactggggggcccaggatgttctaggcagtggaagtggcacatatgaaagtgagagtggtcacagcttgtggccagattcctcatggctgtagctaaagagttgagttagcagatga

SEQ ID NO: 527 - DNA, 50 bp, Homo sapiens
cgcccatcagctcagagaccggggaagccgccattggcctccccaacaag

SEQ ID NO: 528 - DNA, 1024 bp, Homo sapiens
cagcagcaacccacgccaagaagagaaacccacagagcagtgtcggcgcaatcacgctggaaaacggggcctctcgaagcagagtggggatgacttgcccggccttgggcaagcaggagggagcaggcgcggtcggctggctgactgctggggcagaggcaggcagtgctgtggcctgttcactctgcagagcctttttgatgcctaggctggcccctgggctccccattctcctttgttctggaagctccgcccctcctcaccccgccctcctgccagcatccggccggactagcaggatgggtgcctcaccctctgcatccatccttggaccaacaccagccagcccacatcccaagaaaggccagcctctgttgaagggggactaccctgtaccctccctggcctgtgttccagaataacagatgaggacacggaggatgtgatgacattcaggtatttgtcatcagccagtgaaggaaggggaggcagggaccagacgcccatcagctcagagaccggggaagccgccattggcctccccaacaagtgactactttgagtggtcaaaggaaaacagtttacatgtactgagctcctaccacatgccaggcactgggaagtgtctcacacacattctaaagcaggtatgggatcctatgggatttcctggagagggaggcagaggagggttccagcataaagaatgcacagaaatggtcttttttaagtgagtgaggacacacacacacacacacacacacacacacacgtgcacaatcatcttacatggactcaactgctgcagtaattttccttcattgatcacccctgattcagaggcagaggggtggccaagcaactctgggtaggccccatactgcactccatgagcattgtctccaccctatccacccctctccatttccaggaactgttccagggccccttccccaggcactgcagcacttcctctcccactccccaagctggtcatttgtggaaagatcacgggaaatttcac

SEQ ID NO: 529 - DNA, 50 bp, Homo sapiens
cgtctagctgctaatgatgtgatccagaacagggtttgcttaaccatgtg

SEQ ID NO: 530 - DNA, 1024 bp, Homo sapiens
ccacgccccaggaaaggaggaaggtgggctgaacaagcattttgagggccttcagaattggaaagcgctgcttctggcatcaccaggcatttccaggtcactgtggggttaggagtcagggatcctggggctctgagtgaggcatcgacttggcttgatgaagtcctcctggggcttcctgggtgcacagagaggtgcccagagctccgactgcctcttggcagctgtggctctcagctggatctgggctgggatgcagcttctttctggaaggaggaatttagaatccagtccaggtgctgctgcaggagatgccgggaggcccatcctgttgttcaccccttcttgcctttggtgtcaattatttggataattgccaaacccacagtgtggtgaaattactatagattgactgaaagatttgggagggaagaccctggctaattcgtatgggatagaaatcaaattgtaaaccttaggatttaatagctatagctagacgtctagctgctaatgatgtgatccagaacagggtttgcttaaccatgtggtttgcttaagccactctctggtgtttgcaatccaaggcatttgaactagtggtcctctgcttggtagatggtttagtcactgccagaaaactatagttatttctttatatcacagatctgggaggcagtatagtgatgggcaacagttgctcttgggtcagctggcttgatttgaatcccactagctgtatgatcttgggtaaggatcttaactgctgtcgaccaaagttaaggctgttgaggcggaaattgataaaggcttattgaaagccaaatttgaagattgaatggggaagacacaccaacaaagttgggtgtgttccaaagtctgttacaagttgcagtgcttttataagaaagttgaggaatgggaaggggactcctcatattgcagttgtcttttttcattggagggacaatatagaggttacagtcattggctacagatgacaacatacaggctaaaatgtttt

SEQ ID NO: 531 - DNA, 50 bp, Homo sapiens
cgaaacagattgcatttcctagaaggcccccagcgatgtggattgaagcg

SEQ ID NO: 532 - DNA, 1024 bp, Homo sapiens
agggaaaaaatcatcttcatggaaattaattacttttttacaaattgtgaatttgacccttaagagttttcttcctgatatttaaaattgaaaaaaaaattgttgacattaatatttcttctttccttttttttcttttcctttttttttttttttttgcaggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaacttttcattgcagacaagtgctgttgttttgaaaaacactgcaggtgctacaaaggtcatagcagctcaggcacagcaagctcacgtgcaggcacctcagattggggcgtggcgaaacagattgcatttcctagaaggcccccagcgatgtggattgaagcgcaagagtgaggagttggataatcatagcagcgcaatgcagattgtcgatgaattgtccatacttcctgcaatgttgcaaaccaacatgggaaatccagtgacagttgtgacagctaccacaggatcaaaacagaattgtaccactggagaaggtgactatcagttagtacagcatgaagtcttatgctccatgaaaaatacttacgaagtccttgattttcttggtcgaggcacgtttggccaggtagttaaatgctggaaaagagggacaaatgaaattgtagcaatcaaaattttgaagaatcatccttcttatgcccgtcaaggtcaaatagaagtgagcatattagcaaggctcagtactgaaaatgctgatgaatataactttgtacgagcttatgaatgctttcagcaccgtaaccatacttgtttagtctttgagatgctggaacaaaacttgtatgactttctgaa

SEQ ID NO: 533 - DNA, 50 bp, Homo sapiens
cgtgtggagccagagccacccaatcccgtagggacaggtttcacaacttc

SEQ ID NO: 534 - DNA, 1024 bp, Homo sapiens
agagtccctgctacctgttacctccacccctatttagtcctagtggacagcctcgctcaccttccctgggatgacacttctggcggctgagatgagcgagcctctctgggctctgccgccgggtgtgggctgacctgcctacagctggggcctgataaggcagcagcaaaagggtggaggggaggcagtgttgaagctggggcaagtaattttccccaatttacagggaaaaaccgaaattcagaaaagtttaatgtcacccaggggctggagcccagacctctggcagctctcactttcacaatgcccttgggctgactaggctgcagaggggtttcaccccaaccccagggcacctcaagtgtccccaccaaaccttcctaacacctgtccactaagctgtactaggcccttgcaactgacctatgggacctgaggcctggcccctcatggctcctgtcaccaggtctcaggtcagggtccagcaggccctgagctgacgtgtggagccagagccacccaatcccgtagggacaggtttcacaacttcccggatggggctgtggtgggtcacagtgcagcctccagccagaaggatggggtggctcccactcctgctgcttctgactcaatgcttaggggtccctggtaagtgcccccaaccctgatccccatctgccttcaggagggggttggccccattctcctattctaggatgagaaaaaagtcggggagccagaggctcagtgggcatggggcagtgaccttgccctcttgagcacagctgggaagccctaggaacacatagacattgcccacttaggcctctattagcacgtctgctctagcactgaagcagtgtcaggaccacacagatgcacgcacacagcaggcagtgacccctcctgagcctgatctacccctctaacctagcatatgcctttgtgcaggtgagagcccagatttggagtctgaatgcctagccagggcccctggctgggtaatgtgatggctctgagcctt

SEQ ID NO: 535 - DNA, 50 bp, Homo sapiens
cgggctgaggtgataaaggatttctaatcgttaaccacagctttgcaaaa

SEQ ID NO: 536 - DNA, 1024 bp, Homo sapiens
tacctccctgagccttcatgccaaggagggcactggagctggctgtgagggagtgccccttctgccactcctcagtcccctacacttaggcagaggggtaaactgtggctcccttcctccaatttttatcccagtccttttaagcccccaaaccagaaaatatctgatttggagagtgctttctctggtcctgaagttttaaagatttgaacctttgtgatagctttgagggaacaaataccaccaacccaaatgccaccggagtttcccctcccatacccttcactcagaaacccaaggtggcccagcctggctccaccatggggtgaatggatagtgactaggaaggaagagtgcccacctcggtgaatttaaaaggcagcaactatatcaggatggagatacttacagggcagttctttgcagagccttggagggggagatgcccctggagagggagaaagggatcctgagggaggggagcgaagtacaaggggccacgggctgaggtgataaaggatttctaatcgttaaccacagctttgcaaaatccatctgcaaatctgagccgtgggtcagagacttattacagatcagaattaaacccctggaggctgggaaagattgaggcactttagaaaaaaaaaaaaaaaggtttggtgggttttctgtgtgtgtttttttttttctgtcaaaaactccactccagctgggcttttgtgtggtgacctctgtgaacccaggagaggccttgtggggagggggatttggcccaagaaggaattcagaacattccagctttgagggtggtgagaggagggggctctgtcccaccaattaggtgtccctggctagcagccctgaagcccagcagggagtaagctgcataaacacagccctggtgagccagtgcccaagcagccctgcatggcctgcagctccatagacttttctactcagcttgattctctggcaggccctcagccctaccccacccctaaggttggtcccaaggctcaagggc

SEQ ID NO: 537 - DNA, 50 bp, Homo sapiens
cccctccttagagtattctttttctgtttaagataattcctggtcggccg

SEQ ID NO: 538 - DNA, 1024 bp, Homo sapiens
tgaaactacctctgagttctgaccttaggaaccattggaacacttaagaattcagggtcctctctcctctttcaatctatcccctgcttccagggcccaggcctgctccttaccacactggtacctggagtccaggcagtaggagtgtctgaaattgccccatttcagaatgaccctcactcacccagcagcagcaaaactgtcaatggttgaagcagccacaggtttctgggacatacattctgagacatttgggtctccatagtcatcccagcactgtgccaacgtccagtgggttttaagagacaagcttagaaaagaggaaggaaatggtttcatcttcttgtgcagctgtcgtcagtcctcaattctgtttctgctaaccaatcaggaacaattccagttaggagttgagtctgctttatagataagtctattacacaccagcttgtgtccttgtgaaaaccccggggaggggttactgttctgctggccggtatacccctccttagagtattctttttctgtttaagataattcctggtcggccgggcgcggtggctcacgcctgtaatctcagcactttgggaggccaaggcgggtggatcacgaggtcaggagatcgagaccatcctggctaacacggtgaaaccccgtctctactaataatacaaaaaaaatttagccgggcgcggtggcagatagtcccagctactcgggaggctgaggcaggagaatggcgtgaacccgggaggcagagcttgcagtgagcccagatagcgccactgtactccagcttgggcgaaagagcgagactccgtctcaaaaaaaaaaaaaaaaaaaaaaaaaaaaagataattcctggttaaaatcttatccaaaggcattagagcagtttgcttccaacaggagccaaaaatgaccagcaatgcagcctgacggagaagaggggagaagagcctgggaagaagataatgtccagctattttttatacccataggacagaaacttaaagtagaaaat

SEQ ID NO: 539 - DNA, 50 bp, Homo sapiens
ctattattaccaccactgagtggcttaaataatcctgtcaacagcaatcg

SEQ ID NO: 540 - DNA, 1024 bp, Homo sapiens
acccccaacctcaggtgacccgcccgcctcggcttcctaaagtgctgggattacaggactggccactgcgggagctgcggcagctgcggcctctgggtacggggtcagcgggcagtcctgtaatggccacattacaggacaggccatcgcgcctggccacatgccttaattttcaaagtcaaatttgtctttaaaaagaatgaattcctaccctttgggggtatttatttttgcaactaacttccatccttttattaagtaatcaaacatagcccatttgaatgttggaaaagaactgtcagaaatacaagttcttattttgtactttggtaacatgaattttacacttagttgaacatgaagaatcaaaaaagctctggattgttgtaataattgtttagaattttagatgtaccatttgacctttgactttaagatgaatttcagtgtcctcagtaaataaaggcttacccccaaccttaaatagtgacgcacaaaggctattattaccaccactgagtggcttaaataatcctgtcaacagcaatcgcccatttccaaagccatggtgaaacatctctgtgctaatttcttttgttttgtttcctaattttttttttttggcaggtggtgggaaataatctttgtcttctttggagtaaaccttcaacaccggattttttcttttaattatggatgtaaaccccaatatccccataatttacattgggtctcgaccaattgcctaattataagaggatatatttaggctcttatttcatccacacaaaaacttgtgtaacaggtagttggaaacatctgaggcaccactttgattctgttttggatggtcatgttttttctcctccgtttccccagcatgtctgccaccatcctcatgcactgcttccaagtgcctgggagcctttatgagcgtccctaaacctaaaagaatccagaggcggggctcggatgaaccctcgagataagcaagtgagccgcttctcccctctaaaggatgttt

SEQ ID NO: 541 - DNA, 50 bp, Homo sapiens
cggtaagcaacatttgaggaccattcactaacgcttctctgcaggggttt

SEQ ID NO: 542 - DNA, 1024 bp, Homo sapiens
atgcgtccttgttgaaaatgctgataatgctgtttgggtggcaggaagccaatttcaggctacatattgcttggggctggggctggggtcagggaacggggcagggtctggggaaggtttaaggagagaaaggggccaggcagatggagagaggacaggagggccagggtggtcaaggcccggggataaagccgattggtatgtcagcaaaatctgtcactggctttagtgattcgaaaggcagacacattctttcatctctgttaatcctcatgtgatacagaggattttcctgccattaaatctggagaaagaaaaataagcactcaaacctgcacaagtaactattcctcttcaccccttcctcccgtccccccacccccacctttacttctctctcaaaccattttcagcatctgtggctgcctgacttgggagatggatgggctgagggagtggagggggacctcagaggagcaggaccagggagactcccaggacggtaagcaacatttgaggaccattcactaacgcttctctgcaggggtttcctctccatccatttccttgctgggttgtcagtgatgccatctgagttgctgtcagggctgtagcctgacaaagggtttcctaatagatccaaactgtccatttgtggggagcttctgattttctgttgttactggtttcccttagcccaacaccagggtcattaagaaggaaggaatgtgaggaagaaagaaaggcagggcattcaggaagaagtgtggaggcatgggagggttctcatggggccctcctgggcactgggtgacctgtcctttctcccctcaggtaggggtcccacggctgggtggtcctaagccactgggtggatgaaaggccgagggatgttggtcctgcttctgcatggtgagttctcctgccggtgggtgcaagggttgggaagaggggtggaagccacagagcttctgcccaaagagtctttaaagtggcttctgggacagcggtatctggacacttc

SEQ ID NO: 543 - DNA, 50 bp, Homo sapiens
tgcttttctgctagactggcaacatgttttgattcttctcaaataactcg

SEQ ID NO: 544 - DNA, 1024 bp, Homo sapiens
gttaactagcccaacctatttctttaattcggcccatccctttgtttcccataagggatactttcagttaacctaatatctacagaaaccatgctaatgactggcttgctgctaataaatacgtgggtaaatctctgttcggggctctcggctgtgaaggctgtgagacccctcatttcccacttcacacctctatatttctgtgtgtgtctttaattcctctagcgcctctgggttagggtctcccagaccgagctggtctcagcagtgtgtacaggttttccactttctatggttcctagattgtctgttaatactatacttacctctataagaaactgtcaagtttaccgggccgcgagggtgcaggctgcgcagatggtgtggtcctgcgccccgagggccgcagcagctcatccggcagctcccaccccaacaacctggaagggggcgggacttccgtttgtacccggctgtggcaatctgtggtgaagttgaaatgcttttctgctagactggcaacatgttttgattcttctcaaataactcgcaagctcttgtgaagcacaacggcctaccttgtcctgaagaaaacatactctaaggcccacagatgattaaacccagccatttatgtgacaatagcatttttatttttcttatcaagatctgggtatttgatccacacaatggtaaagattcccatgttagccaagatctaaatgattcaaactgatgatactctctgcagaagaggtaagaaccactggcagtagggtggaaggtatgtcattacagatgatgctgacagagaaggtcatctgaacctactttataagaaaggcatgattaaaggagaaaggggaaagggcattctaggttaggaaagattctgaagaaatgtaaaataatatgaaggtgtgagctgatatatttaagaaataatgaatgatatgtgggagtatgtatcatctgcagagatggatgagggaagatgcaagtggaggggaaggctggagccgct

SEQ ID NO: 545 - DNA, 50 bp, Homo sapiens
cgtgtcagcctatgagctggtctttgggacaccagccaaccacctgaggc

SEQ ID NO: 546 - DNA, 1024 bp, Homo sapiens
tgagacggagtctagctctgtcacccaggctagaatgcagtggtgcaatctcagcttactttaatctccgcctcctgggttcaagcgattctcctgcctcagcctcctgagtagctgggattacaggtgcccaccgccacacctggctaatatttgtatttttagtagagacggaatttcgccatgttggccaggccggccttgaactcctgacctcaggtgatcctcccaactcggcctcccaaagtgctgggattacaggcataagccaccacgcctggcccaacctccctctttagatgaccctcagaagtcacacgtgtttgtgtgcagaagtggagggtactgggaagcaggtgcatctgaaaggtccctgactttggatgtcacatctagatttaacagcctccagtttggctacttcctggatgacttagttactcccttttctcattgtaaaatgggaacgtgggtccccccagcagagcctggcccaggtacgtgtcagcctatgagctggtctttgggacaccagccaaccacctgaggctcctcttgacatgtgaggaaatggcagttctaataggttgttacttccccacaccacccagcaaggaggtggccgaggcaggacccgaccctgggagaccctgggggacccatgttcagatctatctttggtccagggcgataaacccgcatcccccttgaagatgttaatatgcagcgcccctagtggccacagctgggaaggagcccgtctctgctggaatctcctgagcgagtttgcagaattgacgggcttggggcatgcaattctcagcaatgtctccaggcactcaagagtgaatatgaatgggtaagaggaccccactttgttgggggccatcaggggaggcttctaggaagaggcaacgtttgtgctgacaccggcgagtaagctggagttaaaaaaggtaaaggggcaggagcgtgcacctggccatgctaagcgctcaagcaaaggcccagatatgggaaaacc

SEQ ID NO: 547 - DNA, 50 bp, Homo sapiens
catatatgaaatcccaattacctgtacttatccatcgctagttcacttcg

SEQ ID NO: 548 - DNA, 1024 bp, Homo sapiens
acagctcccagcactccccaaacagaaagttgcagcaaatttcacacccaataaaggaaacttccctctgccactcacccacacacgagatcaaaaagatgacacctgttgtcacccctgcccggggacgtatggtctttcccggtctttgctgtcagtactctactcccagggtttccacctaaggagagcactcactgatgtacactgggacttcagagcccaaagattgtgtaaaatattcaggcaacaacagccaaaaccacaaggaagccattgacacaagtcttgggttactcacctccgtgcaattcggggccacaccaatgcacagcctgagcaaggctgcggatcccagaacaagcccgtctgcccaagtttgaggtctggttttaagcagcctttccggccagcacagataacactatcctgttctgcaatcagggccaggacactgcagtcagcagccctcacaggtccaactgcagaccgctgtcaagcaaccccatgaccatatatgaaatcccaattacctgtacttatccatcgctagttcacttcgctgcagtccttcgtaaaccaaagagcaggtagaacgagttcaccctgaacacagcatccctttaaatgaccctggagaccgtgatttgccattgccagacaggatggacgggaacagataggcaactgtgtgcgatcacaggacataatggaatgaaatgtcagatcaggtgttaggatttgatctgtgctatggttcaatctgtgctacagagttcacacttggtcaggcttttccacgatgtgtaaaattctacaaggtctgtgcggcatcacctttactctactttgctcaaccacgatcactgtgattaggaagcctgcctatagccacatgaccctcgccacctcccacagcctgggggccagttgtcatggcattttatcaggatcttggtcatgagaaaccactctaaaaatgggtttcagaaagtagaagcaaggcaaaaaaagctctgacaat

SEQ ID NO: 549 - DNA, 50 bp, Homo sapiens
attcactccaggcccctggccaggtggaaactgggcacaatttagttacg

SEQ ID NO: 550 - DNA, 1024 bp, Homo sapiens
gatggattaaccttggctagcccagatacctgtttgagacgccttcacacccattctggctgcagcagagcagggcagggtgtggcctcttcccttgcccacggctcctggtgccagctacctagacagggcctcttccccaggccctgtacttcctttatatacctgtcccactccactccccgacgcggcaaaccagcccttttatgggaactgagctatgtgtcaatgaaggaatcacgaggctggcaagtggaggcgggggagtactatggattaccagaggagggttgagaaaccgcagagttttgaaaactttgggtcaggtcttcatgaggcacctgccagcagaagagccactagggtgatgatggggggcttctggagatgtgactcagccgcatttcccagccttcctcccactcctgcaccccaccactggcctttcttgccagcaatttcctggcttttctggcagcctctacctttgcatcttcagcattcactccaggcccctggccaggtggaaactgggcacaatttagttacgtaagccacagtgccctaaacaaggctgttgttttcttcccaggctcagcattgccctgcttgacctaccttcctaccctccccctcacactttctgtcttcaggctgggtaagggccagagagcctcgggaggaaggaaagcaaagagcctgaaactgagcgctcccttttgggcccgtgtctttttttttttttttttttttttttttgcaatttacatgctgattatttagagggaaagacagggaaattcccaagaatgctttaagccccggtgctattttgcttctgttttgaaattcccataaagagagaggatcttttgcaagctcggtgctgcagtgaggcaccatggaggaaatacaggccctacggggcggctgcacgagcatctgacatcagtcagctccccaactctctcagtgaggctttggaacccaagcctgatgatacagcccctctctaaatccttca

SEQ ID NO: 551 - DNA, 50 bp, Homo sapiens
cgccctcccggccactgtgtggattcttggggatctcagagctgtctccc

SEQ ID NO: 552 - DNA, 1024 bp, Homo sapiens
tgacaccctcacctgcccctgggggtgtggccatcttctagagagggaaactgaggatcagtgcagaatgtagggggagcccaggctggcccagggagcagttggcggtggaggccttgggcaatttcccgtgttcccactgagtggggctgtccctgggcctgggcggggacgccaccaactgccaaggcctgtgtataagggcagccgccgccttagccacagacctgccccgccatgacccggctgacagtcctggccctgctggctggtctgctggcgtcctcgagggccggtgagtgcctctctgtgccggtggtcccccatctgtgctagggcccggctgccagggcagaactcagacttaaagcacagagaaggcaagcggcttggcctgggtcacacagccagcccggcctggacgatcccgcgaaaggcgtgagggcggacggtgtgcgggactcaggggccccctgtcctcttagggagtgggacgatgggggagggtgggtccccccgcagccccactgggtggatagagctgaggctgcagcttcacacgccctcccggccactgtgtggattcttggggatctcagagctgtctccccccgacccaggctccagcccccttttggacatcgttggcggccggaaggcgaggccccgccagttcccgttcctggcctccattcagaatcaaggcaggcacttctgcgggggtgccctgatccatgcccgcttcgtgatgaccgcggccagctgcttccaaagccagtgaggggtcctggggagggggcctagggggcattggggctcagagaaggggcttggggggcttaggcattcagtgggggtgcttggtaggtgaggaggggaggggattgcaaaaggaggggctcagggaaaggagggggcttggagagggaaatggggactgagttgaggagggacccaaggatattggggggctcagatggaggaggcccagagaagggaagggggtcagatggaggaggcccag

SEQ ID NO: 553 - DNA, 50 bp, Homo sapiens
cggcagttccagtgttgaaagggacttcagaaaccgtccctccagcagga

SEQ ID NO: 554 - DNA, 1024 bp, Homo sapiens
aggccggagaatggcgtgaacctgggaggcggagcttgcagtgagctgagatcacgccactgcactccagcctgggtgacagagcgagactctgtctcaaagaaaaaaaaaaaagaacccagggcctgggaagctttgggtcaacccccgagaaagccttccctgttctccagggtgaactcatctctggttcctgagcctcaaatctctgaagggcagagtggggcataggtttcaactcagctgtgattctcccagaacggtgccagggcagtgcttggtcgggtaggctgtgggtggcagtcttcggcttaacacaagaaattgccagaggctggctcagggggaaatgagctgcccagtcctggaagtttccatgaaatgactgaacataggggctggtggcccccattagggaaggggtggaggagggtgttgtgtgagaccaacctttcagttgctggttcactaggttccaagcgaaagggaagatgactcagcggagggaatcagggaaggctgtgtaggagtcagcacttaagctggaccttgagagagtgcggcagttccagtgttgaaagggacttcagaaaccgtccctccagcaggacacaccatccgtcaccaattcacatgaggctcagggagctgaagtcagttgcccatggtcacataacaagttgtgctttaaaaaattcagagagtcccccaggcagggcccatccaggagccagtgtgtgcagccagcttggtaattcaggtccagtggttaattagtaactggaaggccccgaagccagcttccagcaggcagggctgggaggttgaacttgagccggtttgggagccaggagcgagtgggtgacaggtcattcctgactgggaaggttgcttgacaagtcaggattgtgcctccagtcagaaggaccatgaagagagagaagagggcagagccgtgcatggggctgctccccaggacctgagcaggaacctggagttttcaggtgagaggctcacctgtgag

SEQ ID NO: 555 - DNA, 50 bp, Homo sapiens
tgatacacatttcaacctgtgatatatcttttttccaagacggagtctcg

SEQ ID NO: 556 - DNA, 1024 bp, Homo sapiens
caacttggccatccaagggtccccagaaggagcttagtttgctgctgaatcctccccaccaccccagaaaaaaaaacgtgtggttagtggataggacctgttctcccatccagcagggcatcccaagggagcagatatttctattttttttcctaaggtaattttgttgtagcaggagggaatatttctaaaacttgggtagtgggccagaccttactcgtggacaaataggaaaaggaaaatacatagtacacacacacacacacaaacacacacacacacacgggaagggggagcacgaaccttctatttccttctttgcaatttgagtgtctgtttctctacttcctgtctcctacccccaactatattcacacataactccaaggacaggatttcttatgacatactcactagttaactgtgcagtaatattgcacctggctctgtgaacatcttccacataaataacacatctcactttcacataaatcactacctgatacacatttcaacctgtgatatatcttttttccaagacggagtctcgctctgttgcttaggctggagtgcagtggcgcgatctcggctcactgcaacctccagctcctgggttcaagcgattctcctgcctcagcctcctgagtagctgagattacaggtgcatgccaccacacccagctaatttttgtatttttagtagagacaggtttcactatgttggccaggctggtctcgaacgcctgacctcaggtgatccacccaccttggcctcccaaagtgctagtattacagatgtgagccaccgcgtctggccatcaacctgtgatatatctcaaatcctaaatatacccaaatcctggatatatacacacacacacagtctaagtcatacacactgggacctatgacacgcatcctgacctcaatacacacaccaaaactgtgttataacccctaaacctgtgacagcctatcacatacacaccccgatcatttattatgcaaggacttaacctataaa

SEQ ID NO: 557 - DNA, 50 bp, Homo sapiens
cgtccagctgaaggtgtgaatgactgcagtcaagccaactaaatgattgg

SEQ ID NO: 558 - DNA, 1024 bp, Homo sapiens
tgcacgccaccatgtctggcttaatttcttagacctcatcctaaactgtaacaagaaacaactccaaaatagtctttgatgtttttcagctgaaagccatttatctccttccatgaaagtttagggccagttttgcaaccaaactcttgcaacagcagcttttgccagtgtggactctgaaaaaggaaatgcatgtggggtgttccattgctcaagctgaatgcaatgcacaaagtaatctgggcctctcagaggaagggaaaagaaggagctgcctgaagtcaagtttgttttttagagctgtgtgcaccctgttgctcactctttgggcccaggagaatgaggttacagccagctggcctttgccaccaagtgccacagtctaaacagcttcacaggcaaggatttggaccagcccccaggccccttggcccactgctcagttcttactgagcagatccacacatggatcccaggcacgagttgggaagtctgttccacgtccagctgaaggtgtgaatgactgcagtcaagccaactaaatgattggagactgatcttaagggagggagggtattatctatgcctttcaaggatgtgtcagctccccctttctccctctgcccagttttggattgtggaatgatggctgagtaacaggtgccaaatccagcctcacttctgcccactgacttcccaagcgtctcttaggaggttcatgactggacccatccccaggctctaccacagggaaggtgatcttgggcgaatctctgaaacggggcttttgcctgtggtgtgtaatgtgtgaaaaagccagggatggtgggacatggagaatgctttgaagctcaggcagtccgtcaattctcccagaatgcctggcagggatgcagctggctgccttcctgtgcccatggcagacataactatcaacacgtctcagtgatctattgccacaatcaatgcaagccacccagaattcagtggcttataacaaatgtctgtttagcccaagagagtc

SEQ ID NO: 559 - DNA, 50 bp, Homo sapiens
catatgcatctcaataaccgacggtggcatttagtgcagcattaatcacg

SEQ ID NO: 560 - DNA, 1024 bp, Homo sapiens
ggggggaatttcacagcactttgtgttaagcgctgacttatcccttgtataatactttcattgactgtagtccctaatactggactgagctccttgagcgcagagactgtgagtcttacctgttttggcattcctagacacacctggtctgtggaaagtgctcactaaatgtgaatataaactaatgaataaatgggtttctacagcagtttatactgcatcacacagttcctctaatgaatttctagcccccttccctgttggggcatacagtattttattcagtatttctcctgaaggcctctctgtgccaagctcagttttaaccaaaacattggtgatctggttaagtcattactgaattatccactacgttgaattctcccaaccaccccgtcccagcccttagcttggccgaaggaaaattaattggttgcaaagtgcgtatctaattacaacagccagcccccgacacagagatgctcaaatgttaattataacatatgcatctcaataaccgacggtggcatttagtgcagcattaatcacgccacttgggccccccagtgcatacacaaagctccttttcatctgccattagcacagactttgcactttcggcacggacgttctcatccttaaagcctttcggactctaaaaccaacgtttccctgtaagcctggactgcgcctaagcccccagttctcccaccgcagaggcccccacccagggctgcgccagcgccgtggggtcgctgggcggcgggttttggcgtcgctagactgggctgtcttggcagctaaggcgacatcccgagcgtcctggggccaccctgctctccagggcccgccatcctggaaaagaaaggcgaactacattacccagcaggcctccagccgccctctttcctttcaagtctttgcacgtggccggaggggagggcggggcctgaacgtcactctcctacattctctttccctgtgtcagatcagggatcattttttttccttcctctactccctc

SEQ ID NO: 561 - DNA, 50 bp, Homo sapiens
cgcatgatgcaagaaagaggatgatttcacatgctcagtccccaaggtct

SEQ ID NO: 562 - DNA, 1024 bp, Homo sapiens
gcaccagtgcccacagcagcaccagccagagctggacatcagggagccgcatgctcctggtgaatggccctggttcaggagcctcggatggcagttgctccgtctgttgagtctgattgctgggggccaatgagggcacagtgacagcagacaccactgccacacctacccttggccaagggtacagccacctgtcttctattgtctgggactcaggaaggctgaaagtagatcatctgatggatagctgtgcttgaccctcacagctcatgtctggctactgacctggggcctctttagagccagctgcctgggtcttccaaacctagtggtcagccagccgacctaccctctgagtcccaggattggccagctgtgctgcccatcaggcccctgcagggggtggaggtcctcctccccatcagctcaggtttcaccatctggccatggtgactgggcctgaagtaggggtatgggggtgggggggtgcaatgtggacacgcatgatgcaagaaagaggatgatttcacatgctcagtccccaaggtctgggacttgggggagggaacgccttatgagccaggtggggaagggcaattttccctcatacctctagtctttctagcttcaccactgctgcagcagtttccatgaggcagctgtgagttccagtgggtattcctctggggcccttaggccagaaggaaaattctggtctctttatttctagcactggggctaggacagggatgagggtttgggcgggtaggagaatggagccctcttgctcaggcccaggtggcagtgccacgaggcacagaagtcaccccctgaccctgcctgtgctggccgcccagagtccagttggcctggagcatgatgtggagcatgatgtggaggagggccagagccggcgggggttggggcggggaacgtgttcctgtgatgtctggggaagcccagagaggtggtggtggtggtgatgcaatcttacacagggcagagtccatcaggactgtcaggg

SEQ ID NO: 563 - DNA, 50 bp, Homo sapiens
cctgcagatggtgccgattcatgagtgcggctagtgagtccgatggagcg

SEQ ID NO: 564 - DNA, 1024 bp, Homo sapiens
ttgcaccgccattctggatcggcatcttcttcttcaggaggtggactgtcaggccaatagtgatgccccacagaaggcaagagatgatggctgctgtccgattggagatcttgttcagggcgtggtggggatggaccacccggaaatacctgtctaccgccaccaccgtgaggaagatgatgctgccctggcggttcatagccaacatgaagagcatcagccggcaagggatgtccccaaacttccagtcccaacgcctcacatagttgtccatcaggaagggcaggcagatgatcagtagaaagtcagccactgccaggttgaacaggaaaatccggctggatttccaggacttgaggtggaaacagaaaatccacagggcaaggccattgcccagaagcccgaagataaactccagccccaacaccggcggcaacaccttgacaatgaagtcatctcggaacacacagcagttcttcttgtctatttccagaaagtgatcctgcagatggtgccgattcatgagtgcggctagtgagtccgatggagcgcctcgcctagtgaatgctccagcaaggaggtgtgtgtctgtgtggtgaacgtgtggttccacgcctgcctttatgtcatgtcagggtgttgaaatagatgactgaatggttaccaggaaactacgaaatctctaaaaaaaaaaaaaaaaaaaaaagccagcaaggctcttatgcaacctgctgtttgcataaacaagtaataagaatcccctgggcagacgggaacccacaaaatgtcttaaatgtaaaggataagtttaggcaagccgactgtcattcgaaaatcagtgaaacatgaaggacatccctttggaaggctgggtgcttgtatgccaactgagtactcaacgttgcagaattaattcaccgtcatctgcttggctgacataattaacaaaacaacaacaatagcaataacaatttttggtgccaaacagtgaggttttccagaaacactaagaattagcatgaaa

SEQ ID NO: 565 - DNA, 50 bp, Homo sapiens
cggactcccacacaggtgagcccagagcagacggctggtctgcaccccca

SEQ ID NO: 566 - DNA, 1024 bp, Homo sapiens
tactggaagtccccccgaccctccccccaaggctagttcccttcttgggcacctgctctgggggaccatcagctgaacgacccccaagtattttgactcccaaaagcaccaccacctgaccccatcctctcacaccctactggatttgaggatgggccccaatcctagggaaggagtgaagaggttccctagtgttggaagctgtgggtgtgggggagattggcacctgatcctgagcccatagccttcctgtcacctggcgcagctggcggggccagatcctactcgggaagggtggggagggcagccagccagcagggcattctggagggaaacagggtcaaggcgatctcctcccccacgcctgttcctggccctttcctctcagggggcagcaggaagtgaggagaaagggctgggatgggaggcgggagcggatgggagggaatggggtttatcaagtcctcggcgagctgcccaacgggcagcagctggcgcaagtagcctagctggagaggctcaccccaggaaggagggaggccaccgacctactgggccgacggactcccacacaggtgagcccagagcagacggctggtctgcacccccacagatgcgctcgcagttgcactccctccctctcctggcgcccgggagggttaggggctggtggtgcagacgcgggcccttttgggagttgagtctcgcacaagggagcggacctaggaagagccgaggtggtttcgcacggggctcgccagggtctaagcctgccccccaccgggagaggcctgtggagcgtagggggcgctggatacgggatggaggccctgggagacccctcttgctggctttctcggaggtccagccagaaactgctgcaaggaatggaggcctcctcggggttgagagggagccgggctcccaaaggacctcagagactgggcagaaaaggacgggatctcagggatgactgtcccgccctgatgcgagtcagggagaggggcggccaacctcctagacc

SEQ ID NO: 567 - DNA, 50 bp, Homo sapiens
aggggacatgtgtgagcatgaggcctccattgacctctccgcctacatcg

SEQ ID NO: 568 - DNA, 1024 bp, Homo sapiens
cagggagtggagaggcattcccagaagcatcagcttcgggcatctccagaaccctggcttggtccctgaccaaggagtgtccccaactgctgaataggccaggagtcgcctttctctaaggcttacatctctccctctggggtgtgtcctgcccctccctgagtcaccccaaggggagagaggggaaaaaagggaagagaagagaggcattgactacagaggaaggaaaaggaagcagagcagaggggggagagaggccacacaggagtgggtgacagaggagactgcagagggcaggtctagggcagaagatcgagagagggcaggcccaggtcaggaggaggtagagagagggcagccggagcaccccaaggggtgcctcaagagcaggtgggggcggggagccgagggggcgggccggccatgtcccacgggacctactacgagtgtgagccccggggtggccagcagccactcgagttctcagggggccgagctgggcccggggagctaggggacatgtgtgagcatgaggcctccattgacctctccgcctacatcgagtctggggaagagcagcttctctccgatctctttgccgtgaagccagcgcctgaggccagaggcctcaagggccccggaacccctgccttcccccactacttgccgcctgaccctcggccctttgcctaccctccacataccttcggcccagacaggaaggcgctggggcctggcatctacagcagcccagggagctacgaccccagggctgtggcggtgaaggaggagccccgggggccagagggcagccgagctgccagccgaggcagctacaatcccctgcagtaccaagtggcacactgtgggcagacagccatgcacctgcccccaactctggcagcacccggccagcctctgcgcgttctcaaggtaagagcaggccagccctcctccctcctgcccggggctggagaggctggtgtggacaggaccctgtgccccggctcatgctgctgagcct

SEQ ID NO: 569 - DNA, 50 bp, Homo sapiens
cgcaggggccatccctgaccacagcagatttcatcgagtacttgcttgtt

SEQ ID NO: 570 - DNA, 1024 bp, Homo sapiens
ctgcgtgcttcaggcttggggtagggaggggaccaactggtgatttcagcccgcatctactgagcccatcccatgcatccccctatgctgagtccttcataggctcacaggagctcccaagaggcaggtaccatgatgcccatcctacagatgaggaaactgagaccctggaggttagatgccttgcccaaggtcacacattcagaaagggcagcagctgttagactccaaagcccaattcctaatctcgacgctgcacatcctctgacagccgggtcctgcaccaggcacagggacgtgtgggtgggtgggcctccatttccccatctgcggaatggaaacgctgacagccgctgccctgccttcctgagaaggtgactgtgggctccaccgagttcatgggtggaaaggtgcttttgtaaacatgcgggagggggcgctgatagccaattaggcttggggacctgcatgcccagcccctgccttcctggagcccatgacgcaggggccatccctgaccacagcagatttcatcgagtacttgcttgttgagtggtggagcaaggtttggaccgtgccccaggaggcctgggccctctggctgccctctccaccccaatgcccttggccgttgtccccacaggaggatgtgcagggtgtccagatgcaggcccagggcaggggagggggcttaggttgatgtgaaggagtaggcagaaaagcattcatgatcctctgaaagctagtgagaaggccagggaaactgaggctcagtgggttccactgtctcagcctgccagctccctcaagggctcctgacctctccaacagggctcagtccccagactggtgagcatagtaacagccattctgtctcctggggcttcccaggagccaatccccaacagaaaatgcttcacaggaaaatgcatcagggctgccccaggcccacccgggcttctgggtgctcaggaggatcctgctgtcaactctgcaatggaggtagccttgcagctgcctggga

SEQ ID NO: 571 - DNA, 50 bp, Homo sapiens
cggcttggaagtgctctaccagagttgcggtaagcccttgcagtacaccc

SEQ ID NO: 572 - DNA, 1024 bp, Homo sapiens
cagagactcgggggctggagatgggaaacagatggtggcctgcgctttgtctttcccaagtttacagcctcacctgggggtggaggctgttctgaggggcccccaagaggtaagttcacgcatcactactgaccctctccctgtgaaagcagaaagtcagcacgcatcctaccccagaccagaccagccacacctgtagattcaaggtcctgggggaacagtattcaaatgcctctgctctcagccttttacttctgactgtggttcccagcgagtctaaaatttgagaagtgaaactgaacatccaactgccttggtgaggggagaggaagaaattttacaggctttttattggccggttatttttctgtgtgtcccatacaggcccccaccatgaagggtttcacagccactctcttcctctggactctgatttttcccagctgcagtggaggcggcggtgggaaagcctggcccacacacgtggtctgtagcgacagcggcttggaagtgctctaccagagttgcggtaagcccttgcagtacacccatgtgtgtttatggggaaagcaaggcccacagatgtgagccgctagtgctcagttggagttggggtgggaggggagaggggaccagcagctgaacactttctccacctgcagcaggtctgggagggccactgggagcttttggaagaaggagcggtggggccaggactgggagcggaagagaatggcagaacaacaaagagtacaagaaagagaaattgaatctaaatatagccatttactaacaccacagaacccaaaaaagaacaaaatgatcagtgagtctaccaaatcatcaaacctcaccagctgaaaattaggaaaagcagcttccagtaggcccttcctcaacaccgtacacctgggctacctttccatctgatgtactttgcaagtgaagtgaaaagatcacttctgcccaaagagaagattcctgtccctctctggacactttcagagctttcactgcagcagta

SEQ ID NO: 573 - DNA, 50 bp, Homo sapiens
ctaacttcaacttcatgaactgagaatgctcttactgtgctgaaatctcg

SEQ ID NO: 574 - DNA, 1024 bp, Homo sapiens
tgatgtcttctatctccttttgtgttgtcatctttattagagtcaactccttgagggcgaagacttaataaatacatacatttttaaaatacaaaataatatttcagttatatttctaaaaggtctatcatttaaagattaatattgaattaatattgaattaaatcccaaatatttttgggatttaaaaaaatttaacattgataagggaaccgggtggaaatatacaagaaataagactggccataaggtaatcatcatggaaacaggtaataggtatatacaggcccattgtgttctgctcctctacatgtttgaaattgcacacagaaggaaaaataattacaggaaaaatgttaatatttctgttaaggcatttgcaatacagtgcttgtgatctccaacatctctgctggaagaaagtcaggctggaaagaggaaagcactcacagcatgttgataaacagcctagcatgcagaacctttgctgaagacagtgactaacttcaacttcatgaactgagaatgctcttactgtgctgaaatctcgagtcaaagctggaggcaggaacattttccctgactaaaggaagtgaaaaatgccatctcagcatttcataacttttctgatccaggtgtgatctcactatttgtaaagcccagcccttcccaacctgcaagctcaccttccaggactgggcccagcccatgctctctcataatatataagctactgctggagcccgattccttgtcctgcttctcctgcctctcgcctccagcctccaacgctcgccacagccctctcatctcctggaaccatggccagcacatccaccaccatcaggagccacagcagcagccgccggggtttcagtgccaactcagccaggctccctggggtcagccgctctggcttcagcagcatctccgtgtcccgctccaggggcagtggtggcctgggtggtgcatgtggaggagctggctttggcagccgcagtctgtatggcctggggggctccaa

SEQ ID NO: 575 - DNA, 50 bp, Homo sapiens
ccagagcttctcagactgggtgctggggccctgacagtttgggacaatcg

SEQ ID NO: 576 - DNA, 1024 bp, Homo sapiens
ttggcagattcagatgcggtctcctctggactgcaggcagggccctcggaggtgtttttttccatcattgctggactggctggggggccagggtggagtgtgcaggggtcagccgttggggggcctgggcctctagggtgcctgggacacctaggtccaggcttatatagtcaggggctgccccacccccagcaaacgattcccagctgtggggtcaggtcaagcaggaggactggagggtggagaggcgcccaggccaggaatagctctgggggaggaaccacaagggccccttgaggagtcacttcctcatccatctccccgactggccttcaacagccagggtgctggtgcccagctgggggagggcgcagatgggtgagatgggacatcgagcaggccgcgtgccaggtgtcagggcaataggaggaagaacttctatctggagaatgagcccagctcaggctctgtgtgtctggcgtctatggggccacttgttcccagagcttctcagactgggtgctggggccctgacagtttgggacaatcgtccttgtgagcactcccagctttgcctctggggtccacattccctgggctcccacagttcccagggactctcgcctgtgctgtatgaggctgagggccctagagagggagggaattgagatgctgagggtggagctgctcagaggatggtcctccagcattggaaccccaggaaggggcactaagtctcctggctcctgtctcagttgggcggctggtaaggagctcgtctcccctgatgcctgctgtgggcctcagttttccacctgttacagagaacccctcgcccttcgggatgggttgcagttgtaggcagatctggaagatgccctagtggaggagagcactctgaagcttctagactcttccaagcaggctgtgggcatgggctttctcagtgtgccaaaggaggcagatatggccagatttctagtcattgattcatttgttcgataaaatgttaagactgggaatc

SEQ ID NO: 577 - DNA, 50 bp, Homo sapiens
gctgcgaggggctcatgggatccccatgggccaaggccaggtggttgacg

SEQ ID NO: 578 - DNA, 1024 bp, Homo sapiens
ctcccgcccagccaaatgcaggccgccgccctccctgaggagatccgttggctcctggaaggtaacgccctggcgcaggccccctccagtgctgagccgaaggccgaaaggggacaccaggcctcccacggccaggctttctttacggcttcgtcactcacctccttctagaaccttaaggcttctagagccctcaactccctagagccagctttccatcctctcacctcagggcccctttcactccctggagtcccacatcttcttttgccttgaggcacctccacgcctccacttcacctccccggcttctaaagtcctcaggccaggttcttggtcccccatgccaccttgcctggtctccgacctgtccctttctccaaaggactgccctacatctgtagggtttcccgtccccctccttccccagccacgacttcctcacctctcacagaagaccccaaaccttcctgcttagaggtccccgaggctctccagggggctgcgaggggctcatgggatccccatgggccaaggccaggtggttgacgtgagtttttgtcagtgcgaaaaccccagccctccctttatcaccctgcagacgtctaggggtctcacccaccccaaggcaggctcattctcagtatgggatttcctccttttctagaagtgcccccattgtggtgtgttcaccttccaactcccattgtggtgtgttcaccttccaactacagtgtctaagcggtggtttaaagagttccggccatccccgtcaacactcaacacacactgccaacactccaaagagatgtcacaaagagacgttgctaacgggcagtttcatctgctgggtttcgtggtggaagtcacttttacttgctttcctgtaactaaccttccagggaggacagaggcctggaatctgcagtcgcataaggctcccaggaggaaactattcagaattaagccttttggcatctaagttgacatagttgacacatatttaacagacggcctgctttgg

SEQ ID NO: 579 - DNA, 50 bp, Homo sapiens
cgccctctgcaggtaggtggaaaaaaagacaggagccatacagagaaaac

SEQ ID NO: 580 - DNA, 1024 bp, Homo sapiens
gaacactatgattttgcagtcctggtttctacgtggatctaatggtgtaatggatatgaatgtacattgcaagctgttaagtcatttctgctaaatacagaatgacccactgtggtcatcttggaagcctcggccatccctgctggctgtgctccattcttgtgcctcgccattggaacgctctagtgagccggaatgaagttcaggcccatggctgtgatgtcacagaacatgtgaagtcagaggtcctatggaaggtgaggggagaaaatgcccctggaaagggttaagggccaggacaggaatggggcaggaggtgcacggatcctgctgggcactgggagcagggggcggccaaaggcagtgggtgggcaggtccatgcctcccctggccccccagctctgcagggcagtgttcctggttcctatcttgctgctgctgcaggtgaagcctctgaacgggagcccaggccccaaagatgggagccagacagagaaaacgccctctgcaggtaggtggaaaaaaagacaggagccatacagagaaaacaccctcttcaggtaggtagaaaaaaagacgggagagtctggaggctcagggtgaggtctgtgtgaggccaggccccaggtcactgatgaggctagggtgagacctgacataggtctggtttatggggggtaactccagccactgatggttatcatgtgaaataatagtgtcggctcaccatgggccagctgagcttgcatgcaacttctgtgtgtgtaagcatggtgcatttggctggcttttgtcatgcttcaaggtggcccctgactcccccagtgttgaaaccctagaggaggcagctaaccttaggaatggtgtgtgtgtgtgtgtgtgtgtgtgtgtgtgtgtgtgtgtgtttgagttggggctgtgattgaacacagaccagaaaaaacctctagaaagagcatcccctctctggtgaaggctaaggatatgggcaattgggactgcagccctaggcttcaacgtgtt

SEQ ID NO: 581 - DNA, 50 bp, Homo sapiens
cgggcagctccgagcagacagttaaccctgtaacaagacctcagactgca

SEQ ID NO: 582 - DNA, 1024 bp, Homo sapiens
gaagccaacaaatatgaaacactgtgaaaagccagatatttcttttgaatgactatttctttatccttcaagaatagggtataggaaacagcttcttgtaaacaagagaaatcatggcattttttaaaaatcagctttggtggctggtgttaggagagaggataggacaccagcaagaagaaaacaatactgtgacattctgggtttttgtgacattctctgggtgtttcttcatatcctccttctagtgtgtgggctctttaatgctgctctgctgttaataattcagaggcaaagccaggagactgtgcttctgtaggtgctgacttcaggtggctgaattctcctctctctgcctaaggaacaagcacccatcagcatccagcttctcctgaactgtagagagtcacaccaggtggcatctccctcctcctacccgctaaaggggagctcaatgcccagtaaacccaggactgtccctgaggagacagtttccctaacgggcagctccgagcagacagttaaccctgtaacaagacctcagactgcagagcctccaatcctgacctgggtgcagtctttgtggggccacatatggagctgtgccccttacacatcccaatgttcctcttcccaccagctcccccagagctaattctgtccgctcacccaactttatccctggaagaatcaaagtttctatataaattccacaaccagcgagaggaaacatttatttgtaaaacaagtatcctctgagcagcaatctctggaagaggcattgatttgtagggctcagccttgaaaacagatcacagcctaaaattagcaaagccaggaaacgggaaccagcgagaatatagtctgaaaacatgtttaccagacgatttaagatacaggtccctcctcaccaaaatcgcacattcgtcccgacccccaccacacacacccctattcccttacctgaaaaatcaggatcttgcacccctctctgattttgcacacaatactaagccaggatgtt

SEQ ID NO: 583 - DNA, 50 bp, Homo sapiens
cggatacggctggttgggcatcacactttgagaaccgctgtgtaatctag

SEQ ID NO: 584 - DNA, 1024 bp, Homo sapiens
tcaaacgagatggaaggtggcaagtgttccaagaggcgatttattctttctgctgatggacacacttgccataagtagaggcaccacccgggatacggaaaactaggtgttggcatccttcccctgtttaaagccttgttgactcctaagaatgaaatgtggtgttagtctgttaatctctattattcgaggtagttgccacatcagctacaattgtaatgatagcagattggtgtgttgcattttgaaaacacctttattttttcactgtgctccaagacttcattttattcttatggtgaagtactactaccaaggggattccatcaagttctgcatcctatgtaaaaatctaatccatagttctcaaatttagcatgcatcagaatcaccgggggattgtcaaaacacagattgctgggccccacttccagggtttctgatttagtaggtctgagatggggccaattaatttgccctcctgataaatgctaggtgtaacggatacggctggttgggcatcacactttgagaaccgctgtgtaatctagcccatgatttcctaaatgttataatttttcattgtttatcttcattgctttttttcctgcttacaaaagtagtgacgcttgtaaacgttttgaatagaaagagcactagcttttaaaaaaaactggcatgtcttggacatctttcattgtgactccttatagatctatctcattgtttttagctgctatatagtatttcactctatggctgtttcatctttatttaagataaggccgggcgcgatggttcacgcctgtaatcccagcactttgggaggccgaggcgggcggatcacttgaggtcaggagttctagaccagcctggccaacatggcaagaccccgtctctactaaaaatacaaaaattagccgggcatggtggcgggcacctgtaatcccagctacttgggagaattgcttgaactcgggaggcagaggttgcagtgagccgagatcgtgccagtgcactccag

SEQ ID NO: 585 - DNA, 50 bp, Homo sapiens
ccacccaaattaaatgaacaactattatctgcagagcctagtattatacg

SEQ ID NO: 586 - DNA, 1024 bp, Homo sapiens
ggctttagagctatctggcaccaatccctcatctgtacaatggtccagtaaatactttttatatccatcagaaaaaaatgtgatattaggaaagaatatttccagtattaataaatgtcaagtaataattattagttaataagtgactaccacagtgcctgaaatatatagtagagtcttaataagtaactattaaactgatagatgaaagcaagcattttctataacactgtaggaaaatattgtacttttggtcatcgtcatcaatgatttgtactatttttagatctgttcaagaatagatatactttaatatactgtagattgtcttttttgacatctggtaaaaattaaaaaattaaaaactcaccaaaatttctcagtgcttgttctaaaaacaattttctcaaaatttgattaaaggaggcaaaataatatctgaaaagatatgtgaatactgtaataggaattatatacagtattccactaaaatctcagatccacccaaattaaatgaacaactattatctgcagagcctagtattatacgtgaagtgttaccatataaattacactctgagcacctccagcttttctgctatgctgtggctagatgactaaagatgatttcttttcagaaaatgtaggggacagcacaaagattggtgcagactaccaatgtcattaaaacaatattaccagctaacgtacagtgaatgcctcccatgtgctaggaactttgcttcatatgtcgtttcatttaaccctcacaacaatcttagaaactgggtactaacttacacatgtgaaaactggaacttagagaggtgaagaaacaccaatgggcccagagtgctgttgagaggcattcgaattgtctccagagcccacgctcttaaccacaagcctgtactgcctctgcgtcactacaaagaagagggcctctgcttcatcaacccatcctgtcttgtggttaagtcaaggcaggaaatgcttttacagctagagaaatgtattccattga

SEQ ID NO: 587 - DNA, 50 bp, Homo sapiens
cgtagagactgtggtttagatcactcatagaaactggaggcaaaatgcat

SEQ ID NO: 588 - DNA, 1024 bp, Homo sapiens
gccatagcagcaaattcccaaaatatcttgaagaaattgaaaacaagatattttttgaatgagcgtaaactcttgggaatgaattttaatttgagattaaaattgctgttgtctttacttacctaacattcatttcctctgagagccaactccttcctttcaataaattcttattttctatcataatattgctttgtaccgcacaaaatacaattataatttttaatagtcaaagaaattttaagttatcaaacattagtttctttcgtaaccaaaatactgttagagaagtagcttcaactttttaaaattcttacaaacaccagtttattctgttgtgatgagctgatttttgaaacaatttatgcttcatttgttcctctagctatatttaacttaaaggcttgacattttgagttactggggcggttacacacttacacgttttagtcgttgggctttttttttgttttgttttgaatcattcttggggttgaaaacgtagagactgtggtttagatcactcatagaaactggaggcaaaatgcatgacagtaacaatgtggagaaagacattacaccatctgaattgcctgcaaacccaggtaagaagctgggctctacagagtaagtgtgaggactggaatgggaaggtagtggtagtgatgggctcacacaggaaaggtgctgatctagtaaaaagttttcaaggataagagatggaatgtgggagtccataaattggcttataatttgtgtaaaacatgcatatatttatattcccagttctaacaactaaggagagggaacaatgagagaaagatgtaagacaatgagataaggttaagtttaggattgaaaataacagttaatttcactaaaaaaaaatctatacaaactctaaagtgttactcagatacaagataccatcattattacataggtagaaaacctatcatggaagctcttaagagagaaaaggtagaaaatagtatgtaaaggacatttacaaatcaaaaaagta

SEQ ID NO: 589 - DNA, 50 bp, Homo sapiens
caagatggtcctcctcagtattcttagaattctttttctttgtgaactcg

SEQ ID NO: 590 - DNA, 1024 bp, Homo sapiens
cactgcagattattagcagacaatattttgagaaatgctgcattagaggcatggaagtaggatgggaacaggaggcctctggccctttaaggatggattaagggactacttttaaggctgtaggggcaagtaggatcaggctgctttttttcattctagtggataagttaaggaagtgggtcctgaaatggacctctccttttaagttacctgagcctctcaataggtactatcttgttctcagcccgggagagcgggaggggcatgctgccttgtcccaccttctgtttctgtttcttttgatgcaaagaggccaagttatgaggcaactttggtccaggagatcctcttagagaaagcaacatagggcctgcctgcctttctttttcttgccccatccttggttgtggagccaggatgcagttatctgcatgaaaggaaatggtcagagtgacgtcccttgggcttgtgttggggcctgttgttgaacactaagcctttcaagatggtcctcctcagtattcttagaattctttttctttgtgaactcgtgcttttcatggaacacagggcccaaatggcagaaggagggcagtcctctattgcccttctggctgaggcccctactttgcccctgattgaggagctgctagaagaatcccctggcgaacagccaaggaagccccggctcctagggcattcactgcggtacatgctggagttgtaccggcgttcagctgactcgcatgggcaccctagagagaaccgcaccattggggccaccatggtgaggctggtgaagcccttgaccaatgtggcaaggcctcacagaggtgagttgttatgcccccatactgccctggaagggagagaagtggagaggagtgtagagaaaagggaattggtgggtttactgtcaggctttgttgccttgtgggcaggttgtttctttaggcttggttttcaaaggatggcaagctttggagaagccagcgccaagcctacttccctttagggcatcaac

SEQ ID NO: 591 - DNA, 476 bp, Homo sapiens
cctgtgaaggcagaacagaaagggactttcagcctcttgtccatcccaactcaacccacaggagggcctcttttcccacccacacactgctgtggagtcagagtatataaaagacccaggaagcctctcccacaaagggtcaggctctttgtagcatctcctccttggggcacttcccatctcccagacctttccatcgttcatccccagccccacctcacctcgggtacacagggccacgcagtgaccaccgcgggaccagggctggtgagcagcccagtatgcaaagttccagcggctgccgtcaacccactgaaagcgtctgcagcgaccctggagaaagcaagaggggaagaagggatggggcagagggaaggcagagaagcagacctggccccgtatctgccagctctttctgctgcccaccgggcaatgggcccttccctgctggaccatgatgggaactgtcctagtca

SEQ ID NO: 592 - DNA, 1024 bp, Homo sapiens
aatcaggtgttctatgaagagaactagctgagcccattcctccatctccaaaaggctccatagacccaactccaccctccatcctcctcctcaaggagtagtagcttctgacacttctatgaaagttgtggtgtggggagagatgataaggaagaagtttcaatgagggctaagcagagtggatccgcgatcagaggagaaaataaatccatttcagtaaaacccattttattgcagggaggtggagggagggatggcaagcagaggaggggaggcagctgcccaggagagggcagctctgaactgctggctgggaccagctcagtaggaacagatgaaaggaagtcttctgaggcagtgggctcgacgccagtggcctcctgtgaaggcagaacagaaagggactttcagcctcttgtccatcccaactcaacccacaggagggcctcttttcccacccacacactgctgtggagtcagagtatataaaagacccaggaagcctctcccacaaagggtcaggctctttgtagcatctcctccttggggcacttcccatctcccagacctttccatcgttcatccccagccccacctcacctcgggtacacagggccacgcagtgaccaccgcgggaccagggctggtgagcagcccagtatgcaaagttccagcggctgccgtcaacccactgaaagcgtctgcagcgaccctggagaaagcaagaggggaagaagggatggggcagagggaaggcagagaagcagacctggccccgtatctgccagctctttctgctgcccaccgggcaatgggcccttccctgctggaccatgatgggaactgtcctagtcatctgaaatgctgatccacggcaattatcaccatcagattctatgcatcccagtgacaggcttgtccttccagccctaacaaaaggtagaacaagggttgccaactcatcctagagatgaggaaacaaactcatggtcttgttttaattttttttttattttatttattt

SEQ ID NO: 593 - DNA, 50 bp, Homo sapiens
tggaacatagcacgtttctctctggcctggtactggctacccttctctcg

SEQ ID NO: 594 - DNA, 1024 bp, Homo sapiens
tgcctggcaagaaacactttcaagtgggcctcactcccatcagtaatgtccctctcaggtcccttcccccacccacctggagtagccttaccttgcgagagaagggtagccagtaccaggccagagagaaacgtgctatgttccatctcccagcggaactcatccagtagataaagccaggtcaccgaactatcagcctgggtgagagctgccctcccctagctgactcacaggtaccggaaagaggagagtgggggaggaactagaagatgtctgcttctctgctttctgccgttgatggtgggaaattttcagagtgggggtgggctaggggtagggtaggaaggaagcggtgtaaattgctctatctctgagcagggagctggcagagaatatggaaaaggtggcctgaactttagcgtccctattgacaatgcaaccacatttacacacaacctaaacactgccacatctcgaagccccttgagagaagccgtcggccccatagcgcaagccgtagcagctagatttctcatggaggctgatctttctcaggacccttcactaggcagccagggacaccagatctagcagcttcttgtcagtgggaggttgggctttagagaccccagccagagatttgaatcctgggtccaatactgcctacctgtggggcctgggccagccataaaatttttcagagtcttattccattagtaccattattaggattcaaacaagatatttgcatggtgcctcacgcatcatatgtgctcattaaggggtagttattaataataatataattgactgacaggcaatattgagcctcccggtgagacaaatggacctttttcccctgtggcctacgaggatctgaaactcttcacgctgctgcagttagactgtcacttacctggggacagagtcatgcctgtcttgctcactgctgtatcttgtgcctggcacataacgggagctctgcacatttttgttggctcactgactgactggctgagggaga

SEQ ID NO: 595 - DNA, 50 bp, Homo sapiens
acccaggctgatagttcggtgacctggctttatctactggatgagttccg

SEQ ID NO: 596 - DNA, 1024 bp, Homo sapiens; identical to SEQ ID NO: 594

SEQ ID NO: 597 - DNA, 50 bp, Homo sapiens
agctgctgcacaggctggctggctggctggctgctaagggctgctccacg

SEQ ID NO: 598 - DNA, 1024 bp, Homo sapiens; identical to SEQ ID NO: 594

SEQ ID NO: 599 - DNA, 50 bp, Homo sapiens
cggaaaaacaaaaggcatctgcacctgcagccctgctgaggcccctgctg

SEQ ID NO: 600 - DNA, 1024 bp, Homo sapiens; identical to SEQ ID NO: 594

SEQ ID NO: 601 - DNA, 50 bp, Homo sapiens
agtcatctgttttgctttttttccagaagtagtaagtctgctggcctccg

SEQ ID NO: 602 - DNA, 1024 bp, Homo sapiens
tgctgctccatgccagatccaccacacagaaagcaaatgttcagtgcatctccctcttcctgtcagagcttatagaggaaggaagaccccgcaatgtggaggcatattgtattacaattacttttaatggcaaaaactgcagttacttttgtgccaacctactacatggtctggacagctaaatgtcatgtatttttcatggcccctccaggtattgtcagagtcctcttgtttggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatggtgagtctctctcttataaagccctcctttttcatcctagcattgggaacaatggccccagggtccttatctctagcagatgttttgaaaaagtcatctgttttgctttttttccagaagtagtaagtctgctggcctccgccatcttagtaaagtaacagtcccatgaaacaaagatgcagtcgggcactcactggagagttctgggcctctgcctcttatcaggtgagtaggatggagtggaaagggtggtgtgtctccagaccgctggaaggcttacagccttacctggcactgcctagtggcaccaaggagcctcatttaccagatgtaaggaactgtttgtgctatgttagggtgagggattagagctggggactaaagaaaaagataggccacgggtgcctgggagagcgttcggggagcaggcaaagaagagcagttggggtgatcatagctattgtgagcagagaggtctcgctacctctaagtacgagctcattccaacttacccagccctccagaactaacccaaaagagactggaagagcgaagctccactccttgttttgaagagaccagatacttgcgtccaaactctgcacagggcatata

SEQ ID NO: 603 - DNA, 50 bp, Homo sapiens
cgctgcagtcagactccaaagtcaggaacgtgagggctaccatctctcaa

SEQ ID NO: 604 - DNA, 1024 bp, Homo sapiens
cagttaccacctgcaataaactgagagactccttcctgccgcaggtggagctgggggctgggcccaaaggcagatggagacaggggagctgtactcaggctgaaagcctccccaaagtctctgcagctcccttcacctggtcaaggacttggtcaggtcaaggccaataagcccctgggggcaaaataaagaccatacaatgggccagcctaggaggaggcagagtattagccgcacattttgtaagacagcatcaaatcattaactctacaaatttttgaaaaacttactatgtgccaggcactttccggaggacatgaggcatcgggtgaaaggaaaaagttagtcaacggcagccgagatgagcacgctgcccagaatattgtgttttttttttttttttttttttcagtatctcacttgggtcccatttcagatacagtgaccaagtccctgagaggacaaccatgtgattctgttcatgtagcccattcgtgcaggactgggcctgccatcatgtgtattttgtgcttctgaagatcatttttcagcagtgggggtaagagtgatgaatttggccaggcacagtggctcatgcctgtaatcccagcaatttaggaggctgagacaggaggattgcttgaggccaggagttcgagaccagcctgggcaacatagtgagaacccccacccccacccccaccaccgcctgccatctctacaaaaatataacgaattagctgggcatggtggtacatgcctgtagtctcagctacttgggaggctaaggcaggaggatcacttgagcccagtggttcaagtctatagttagtcataattacgccgctgcactccagcctgggtaacagaatgagaccccaactcaaaaaaaaaaatgaatttggattgagttaaagggagacctctccctctcttccaattgagaaatatcacccctttgagagtgagagtgcactgtaggctctacagctgaaatgtcttgagagatggtagccctcacgtt

SEQ ID NO: 605 - DNA, 50 bp, Homo sapiens
cggcagagcacacagctgcagaagtaaaaaggattgaaacatttggatcc

SEQ ID NO: 606 - DNA, 1024 bp, Homo sapiens
ccgcatgctctgaactactgttggggctcctggggccccccctggagctagccccgcccctgacctcacaggcctccattggatgtcccaagtatcagtctgccacagtccccccgaaggggtgtggttttctaaccctgcctctgccttctgcctgcaggagagaccaccccctctacctccagaatgcacacattctgcccctagcctcctgtctcctcacttcgtttgtgaactcctagagtcaaagaagtgtatctgtggcagcaaggaccttggaataatcagccctgcctttgagtttcatctctgccatttactatttgagtcaccttgggcaagtcacttctctgggcctcagtaacctcattcatgaaataggcataatatctgcttacctcatttggaggtgggggtgaagatgaaatgacgtgacgaatatgagtgtggtttgtaagtacacagtagcattcagtggtatggttgtttcttagagatgacggcagagcacacagctgcagaagtaaaaaggattgaaacatttggatcccaagaatagggtggaggagccagaagctggcctcctccctctccctgacttggtactgggaagcctcatttgctgcctgggaatgacctgggggtgggtgtgtgagtgactcagatcctcccatcaagctctgaaaggggcaaccccaggaaggacgtgtggtggtcttcgaagagaaaaatctccttttcttgggctgatgacaaatgacatttctctgaaatcaggacttgggtttctttcacttcctgcccaaggggtcaaggtccccggaggtttcccctcttttcacacttcagaactctttaatctggggaagggatggggtcttagaggctcaactttctttttctgtttcttattattctcttatccctgatcctatagcaaaattttcatttatccaacaaattttgatgacatgtttattttgagacggggtcttgctctgttgcccagtggtacgatcacggc

SEQ ID NO: 607 - DNA, 50 bp, Homo sapiens
cgcactcagcaaggcctcctgccctgagagaggctccgcccactaccccc

SEQ ID NO: 608 - DNA, 1024 bp, Homo sapiens
actgcgcccggcctagggtggaccctatttcaatatgactggtgtcctttggaaaggggaaagggggacagtcacacccaggcagaacgtgatgaagatgaagatggccatctacaagggcaggagaaacctgaacagaatcccagctccgggccctcagaaggaccccacgctgcccacattgaccttggacctccagcctgcagatcgtgagggaagagacgtcttcgacttagggccccttgtcgtggtacttccttagtttggccccaggaaaccatcccaaaggcaagggcgtggttgtgctcagctgggggaagggggctgggggccgtgaggaggaggtgggaggcccagccaggctggagggtcagaacccgtggagctagaagagcccgtaggggagccccaagattgctgagaccagtgaccttcggccccagatggccttgccttggcccagaagggtcagaaggacctggtcagccaagctcagacagccggcaggatgccttccaccctgcagagggtcctatcttgtcccacaggtagatctacatcaccactagccacccctccaacgtgcacaggcccctgccctcacggcgcccctcttaggtccggcagttcctgcctccttctgatccagaagtttctctggcctctggagccggggcacacctcatgcaaggacagggtccaaattcctttgtccttggatcccacttggctgacgtcaccttcctgtactcagggagtttccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccc

SEQ ID NO: 609 - DNA, 50 bp, Homo sapiens
cggtatacctgccctacttcggtatagtccttggcacatggcaggcactc

SEQ ID NO: 610 - DNA, 1024 bp, Homo sapiens
gggtcacccagtgaactaggggcagggcaggacagggcagggccaggcctctgctgtgctttctcctttcctccctccaacccaggcactatctccatcaaaagttgtgttctctccccactagccctggtgggctctgcctaatcccatttctctttccttaggggtattctgcagtcttcccttctctctctgggaccaagtggttatttccatttttctggactccattctgactccagtacacaccctgtgacccccctcagcagctgagaaacagagcctcttccaaacccatccctaccttccaaatcaagcagaaccctctgctgcccactgggagtcacaaggaggggacggaactgagctgctgggcctcagtgtcccaggacagtggagtctgtgaccaaggtgccgattaggaagaagtctgagctgaaggcagagcattagggatagcagctgggggtgatgttggaagaaccctccctcagtataatcggtatacctgccctacttcggtatagtccttggcacatggcaggcactcagatgacagcactcatatacatccctgcctccagacccactcatgggaaactgatgcaggagagattgggcttttggagaggtggaggtgggggtactgtgaaactggaggagggaaccaggtcaggggatcttaggaatgcagaaaggagttcagagcctttctcaagtctggacaggaccctcggtatccaggtcagagccctcttcccaagaggttgggaccaggtgggccagagcttgtaaggagaggaggcagaagggctggtgccctggtactcacaggtgcgtgcagagcagtccttcctctggcggcagcagcagcctttgtgtactgatctgggagacggcagaggaggaagtgacactccccagggtggggaagatttggggttggtgggggtgactgatctagaaggtggtgcagataggggtggggctgagccaagggagtggacaatacagagatctggaa

SEQ ID NO: 611 - DNA, 50 bp, Homo sapiens
cggctgcctatccggtgctaggctctagctgggtactgttcatacagggc

SEQ ID NO: 612 - DNA, 1024 bp, Homo sapiens
aaaaaattaaggccgggcacagtggctcacgcctgtaattcccagcactttgtgaggccgaggcgggcagatcatggggtcaggagtttgagaccagcctgactaacatggtgaaattccgtctctactaaaaatacaaaaaattagccaggtgtggtggcaggcacctgtaatcccagctacgcaagaggctgaggcaggagaatcgcctgaacccgggaggcggaggttgcagtgagctgagatcgcgccattgcactccaaggtgggcgacagacgagactatctccaaaaaaaaaaaaaaaaactagctaggggtggtggtgtaggctgtagtcccagctacttgggaggctgaggtgggaggatcacctgaaccaggggaggcagaggctgcagtgagccttgattgtgccactgcactccagcctgggtgacagagtgaggccctgtcttaaaaaaaacaaacaaacccgaaaaacaaaaaacttgaggtttcccggctgcctatccggtgctaggctctagctgggtactgttcatacagggcacataatttaatacccactaacccttgcaaggaagttaggattcccattttacagatgaagaaactgagccacagaatggggaggtgtgaggcagtggcttcccgagcccctgtgtcatcccagacctctctcaactaatggagtctgttcactccagccctggttcttccaggtcctcctccctcaagacgcggaacccaggctggagacccagacctcacaccctgactctaccgactggtcagaggcagttccccaagaccccagacccaagaccccagtcccatgacctcaacccccaatacctccatccagaactttagacccaggaccctggacttaataccagagacccaagacgccataaggcggaccccagtctccaaacctccaatgctaccccaagatcgactccagactcagaccccgacttcaggacccagccccaagcccagaccctagtcccccctcag

SEQ ID NO: 613 - DNA, 50 bp, Homo sapiens
cgaaggcccccagctgtgggagcccacgctatttattggtgatcaaagaa

SEQ ID NO: 614 - DNA, 1024 bp, Homo sapiens
tcgacctccccatcacccggcgcgtaccagcgcccgctcagtgactcccaggtttggtggtggctaggggtgggaggtgagccgaaagggaaaaagccaccccacccaagtcgccgccgggctggagccagtctgcgcgggttccgagtccccggcgacggcgccagccctctccgctcgcccgcgcggtgttctcgccggcagcccctccggaccccgcgccccttctcgggcgcccgtccctccggagccctaacgcctgtgcgcgtacctggcagcagagacagcagcagcagcagcagcagccgcggcggcgacagcgccaggggcagcgagagcgggccagagcccatggctggtggccgggctggccgcggacccggacggtcgggagcgggcgcggcggtcgcagagacggcctctccccgcgcggctccagcgcagaccccagacctggagccgtgcgggcggagacgcgcggggctcctctccgcttcgccgccgctgggtttccagcgccctcggacccgcgggaggacaggaaccatccggagtgaagctgcgccaggcgcgggcgggcgggcgggcgtgcgcggggcggggcgtacgtgcggtaggggaaggggctccaggtcccagtccccagcgccgggcgagctccttctccgccgggctgggtgctccggccggcggcgtccgaccagatctgagcaggtgctgtcaccaccaccaggaaggagagggactcagtttctgtcccaggtttccggggcgtgtgcagctcccgcagggggttgggaccaccgggctaggcgggcgccgtaggagagacgctaacacaccctgggaaggacgccttgtgtatctcatgctattaaataattgttaaatattttagccgggagcagtggctcacgcctgtaatcccagccagcactttgggaggccaaggcgggcggatcacgaggtcagagaccatcctggctaacatggtgaaacctcgtctctactaaaaatactctac

SEQ ID NO: 615 - DNA, 50 bp, Homo sapiens
cgctcatcaggacttcagcactgcccgtccatggggacgtctgcactcac

SEQ ID NO: 616 - DNA, 1024 bp, Homo sapiens
tagagcaacactcaaagccttcctttttaaacgagtacagacaggtagcagtcaagataaaaaccaaaataaagaaatcaaaaaagcccagaggaaacaaataatcagagaatacggataatttccaaaaaatataatgactaccctccaagagatgatgggactatgcattcatggaacaagaacagattgctgagaataattatccaagtattaagtgtgggagcttgataaggcttggctccgtgtccgcacaaaatctcctgttgactcttagtccccagcgttggaggtggggcctggcgggaggtgcttggatctcagggtggattctcatgaatgagctagcaccatcccttggcactgtcctcgagacagtgagtgcgttctcatgagatctggtcatttaaaagtgtgtggcagctcccacctcgctcttgctcctgctctgaccctgtgagacgcctgttcctgctttgccttccaccatgattggaagcttcccgaggcctccccagaagcagaagctgccatgcttcctgtgaagtctgcaaaactgtgagccaactaaacctcttttctctataaattacccagtctggggtatttctttatagcaatgtgagactggattcatacagagctcttcctgagagaaaaaagaatgcgaaacacagtgagtgatcaaaggatcaggcaggaagttctaacatttgagaagggcctgggaaggcggaggtggcagacagcatgggagacagtcagcaagagggcggaagacacgtcccaggccccggcaacggagggtcccagcgtgagaggactcccaaggctggagctgggtgagaggggaagagaaccctttgaggcatcctggtgactccttaggggaggggaccctgtgcacttccagagagagagaggggatttcccagccctcacacatctgagggcctggggcgagggggtgctgccgcagtggcaccgttcccctcagactcgctcatcaggacttcagcactgc

SEQ ID NO: 617 - DNA, 50 bp, Homo sapiens
cgccttgagctgtacctggcacatctttgttgctcagcaaagagtggttg

SEQ ID NO: 618 - DNA, 1024 bp, Homo sapiens
ggcgggggtcctggagaaaggaagggccggccggcgggcgccccacagccggaaggggcgagcccgcaaatagggctcaccttcaggtcgttctctggcaggtacttgcacagccgcgctatttccacatacttgtccaggtctagcggcgccattttaagaataacaagccgcggcaacagcggcggcggcggctgtagcagcggcggcggcagcggcggaggccgaagccggaactttccctgcgtcacgtccggcccgtgagtggcgcctgcgcagcgccgttaaagcgcgacccgtttctccccgctacgtcggtacgcccggcgccccctctggctgaaccccgactgcaggccccaagagagcccgcttcggtccaccccgcgaaacctgctgggacccgtagtcgtctgccgcgggggtgctgggatgtgtagttttctgttgtggacagccacccctctcttttcctcccgttcctccagactttcacctcccggcagccggcgaggcttttccgaggcaaaacagcggagtaggtggtcctagccactcactggtttgtttttccaacccttttaagcactctccagaatatcttcacttaacaattgggtaagcctggccgtagtaaccgtttgcacctttccaagtccctgtgaaaacctcgcctaagcctgtggcagagatgtcaggccccagtcttccagcctgaaaggaagggaaacgaatattattaaagcatttctgatgctaaatgcgatacaaatgatatttttccttttaatcttcgtaacgattgataggaaagtgaggctaggaaactgcagttcaccccaaatctcacagggaacaaaatggtggggtcaagattgaaaaatggcttaagcttaagcatgcttccagtgagaatcccacgagggcagggagttttttgctgtaactccagcaccgagaacagtacctggtactagcataccttcagcgttcgtttatccaaccactctttgctgagcaacaa

SEQ ID NO: 619 - DNA, 50 bp, Homo sapiens
tggctcaggtgcctgcatctccacaggcaggacctcatggtggtgggtcg

SEQ ID NO: 620 - DNA, 1024 bp, Homo sapiens
caagtggaacacacagcatggctctttcgcttcaggacgtagagaatggcatgtaagaactaacccagtgctgctgccattactcacagtcccagaggggaaagcagtcatgtcttctgtctgcactctgcagacctaacccatcagttctcaaactcctgtacgtgtcccacagtatctggacatgtccatcccatgcgtcttggttgcccactgccaccctttctgttccctgcaagtcttcccattagtctttcttcccagtgcttcttgagaacactcctgacccctgacactcccatgtggacacacaggtggctcagacttccccagtcctccctgggctatcatttttctgtttcctcaaatgaatgaaatatgaggagtggaaaggacaagaatcttacctggaaggctttgtttgaggctccttaataaaagagggcaaggcgaagagaaagaagaccaggacagccagaagcaaggaccactggacgccttggctcaggtgcctgcatctccacaggcaggacctcatggtggtgggtcgggttctagaggaaggttctgcatgtcctggggccttgatgtaggcagctgggagtctcaccgctcaggtttcctggccaggaagtgcacaccctttgtcttaacaatgagccactccggcaagtgctgagtttatcagtctctgcctgggaagggaggaaccgccttcactgctgtatgaaggcttataagctggcgtggcttaaaggaagggaaactccttgtgttcaaacatgtttaccttccttttttgtctttgaagccaatatctgaaagtcaagctttatgagaaatataaccacattatatgcagtctcatcttggtcaggttacttaacccatctgccgccatataaatggaaaaaagcagttatcttccttttgggattatcatgaagacaccttgaggccaccatgcacagggctttgtttgtggtaggcacccaacacacatgttcaacactttagctcaacc

SEQ ID NO: 621 - DNA, 50 bp, Homo sapiens
taggtcctagaacagagcctggtgcacagcaagtgctccagcaatggtcg

SEQ ID NO: 622 - DNA, 1024 bp, Homo sapiens
tcttaaacggcgaatcagatcgggcccctccttcacttaaaacccttgggtcatagagattaaaattcaaagtccactagtttttgcctagtctctcctcctgatctctccaacctcattgccctcctatctactccttcctcatcgtattccggctacaccagccgccttgatgatgtaaaatgtaaaaagcaagtccatctcagctccaggcctttacccttactgtacccctcacccaggcgactcctccaaatctttgcctaactgcctccttctgtactgaggtctcagttccaatgtcactttataggagaggctgtcctgtccagcctcctctatcacatctccctggcttatcactttcattgataactcttagaaatggtctgtcttctccattcatcttgtgctcgtttgcagtctgtcttgcgcagccgactgcaagctctggagggcagggtggtgccgagctttaatctccttagtcactgtatctctaggtcctagaacagagcctggtgcacagcaagtgctccagcaatggtcgtccaacgtcaaaagcgagtcctgcctacatctgtgtttgtgttgcctgtgctggtggttcccaccctccacgtcctccccacacgtggacacatgtttatgatccaactggaacatgaataatcccctctctcctctctctatgcttggtctgattcctgattctgcccgtttcttctcttccgtgcccgaataaatgatcccaaaggactcagaggcaggagatggcttagttggcctttggctgacctatggccaccctgtgtcctcaaactaaccagaaccttgccattgactcaacttcactctcactaagggagacacaagacaggaacttggggttgggaaactctgcgaccgaggctagccctggtccaggtgacaaacaggaagtgcgcaggcattgcaaagacacacctggcttcaggtatgcggcactggcagctggctccctgcccagcgctcctcccctaaa

SEQ ID NO: 623 - DNA, 50 bp, Homo sapiens; identical to SEQ ID NO: 305

SEQ ID NO: 624 - DNA, 1024 bp, Homo sapiens; identical to SEQ ID NO: 306

SEQ ID NO: 625 - DNA, 50 bp, Homo sapiens
cggcagagtcacagcagccacctcgtcttgcccacgctgcagcctgccca

SEQ ID NO: 626 - DNA, 1024 bp, Homo sapiens
ttggtgtctgaggaaaaggaggctgatgtgtagaagcaaagtaactgagggggagagtgggaggaggtgaaatcagggaggtaacaggatcagagagtacagaaatttgtgggctgtgaagaggacttgggcttttgttctgagtaaagtgggagccatgcaaggttctagggggagggggaaccagatctgactctggtgttcacaggcaccctctggctgctgagtggaaaaatagactggggggtggagaggggcatgatagtggaatcaaggagaccaggatagaggaggcttgggtcgcattttacaagggaggaaactgaggcaccgagacattcaggtggaggatacaggacttgaacccaaatctttcttgggccacagcctgtgccttctgccaatggtgagacccagccctctcctccccacacccacccactcacctgaacgaagggcacagccttacacatcccctggatcacttcctgagggttcagcggcagagtcacagcagccacctcgtcttgcccacgctgcagcctgcccatccccagctgcctggctttctgcaggcccaagaaggccttccagctcccaagggcagaagctggcaccagtgggggcagggcccctgggcccagagcccaggtctgattggctgcagcccaggactgaggtcgaggagactggggttcaggcctccctgagcctgtaggcagggccccgctaagcaggcacagaagagtggatagctggccaaggagcatctgcttgtccgtgcgtctgtctgcctgtctgtctgtccggactgggctcaaggtcactagcagtcgaccctgctgtctggtgagtggcatctgagccttctgaacctgcttttaatctcttggcccctcctggatagcctgggaggcatttctgtagacccacagcgggggaggagagtaaattcagaccagctgggttcccacacctcctcccaacttgctgagagacatgggggctggtcctgctgtgtgcg

SEQ ID NO: 627 - DNA, 50 bp, Homo sapiens
cgctgcgccacatcccaccggcccttacactgtggtgtccagcagcatcc

SEQ ID NO: 628 - DNA, 1024 bp, Homo sapiens
tgggtggatcacctgaggtcaggagtttgagaccagctggccaacatggtgaaaccctgtctctactaaaaaaaaaagaaaaaaaaatacaaaaaattagccgggcatggtggcaggcgcctataatcccagctacttgggaggctgaggcaggagaatcacttgaacccgggaggcagaggttgcagtgagccgagaccgtgccattgcactcaaggttgaccagccaggaagaggcagagctggtttcaatcagccagaggaaggtcatgacactgaccctcctgttaaaacgatgtctgacccctgactggggacggaggtgaagtttgtgcttcacgtaccctttgcccttcacgtctagttgctgggggcctgtggcatggcccctgggtgtctgggcctgattctttcttgggttttgtttctgtctctcctcccctgtctcctcctcccttctgccaccacccgcctcagacttcctccttcacttgcctggacgctgcgccacatcccaccggcccttacactgtggtgtccagcagcatccggcttcatggggggacttgaaccctgcagcaggctcctgctcctgcctctcctgctggctgtaagtggtgagttaggggcttccgtggctgcctcccgggtccctgggctcagcttggggcagggcagggagtggggtggaacgagagaaccaaaagtgggtgttgggatgggagcaggtccccaacctcccaaagcctgtgggtttctcccagagcccaagcccccaagttttgtcgtccgctacaagcaggggagaagagacatctaagtgtgttgccacaggacaagttgtgcagaagtaacgcacatagtccggtggcccagacgccagccccctgagtcccgccagacacgctctcccccttgctaacctcttggctgtcaggatccaccttccctggcttctaaacttgcctcccccacccccgtcataactctgtgcctcagtttaccttctttttcctcctcaggt

SEQ ID NO: 629 - DNA, 50 bp, Homo sapiens
cgcactctctcatcggactccccaaaccggtctgggtggcacttgaggct

SEQ ID NO: 630 - DNA, 1024 bp, Homo sapiens
ctcccctctgagttcccattattcagtctctgtgccttctgggacgcggaccccctctccacctgcatttcactcccttcctcctctccttgggtctccctggcttttgaacgctgaaaggctgggcccggatggggaggggcggccagtgtgagctcgaggcgccctgtagctcccatcccccaaccagagatgtgacccctcctcccagcttgaactttcgaggtagccgttttcccctggaggttcgggggtgggagggccaggagatttatttggagccttggaaggggaaagggttagctggtgttggcctggcccagtcccccaggcgtgaagaaggcggggcactccttggccgcgccgggttctcgctttcccttctcgggagacagctccgtgcctggggaggcccctccgaggagtgagtgaccagggggtctgggaattggtggccaggtagacgcatttgaaggctgtggccgatggcattcgccccacgcactctctcatcggactccccaaaccggtctgggtggcacttgaggctcccaggccaaaggagacctgtaaggggaactccgcttgtttctgcttgctgcagagatgagattatgggaactgagtgctgggaacatcccaagttcaagacctacgccagaggcagcttcaaagagagaatgtggggtggtgggattagtcccctcctcaactttcccctccaaagggtttcttgttttacaaaagggaagtagcagaggatgtctagctgggatgattaaaatgtgctttaatttgcatactagaccctgtacagcttagtagtagataaaattaccccctatatgataaataaatgtgaggatctctcaattaattttggccacgtggacacaatcttttaagcatttgtactgtaggtcaggtcagtttaaagggagaaatggaaaagatatctctgtgtccagccagttctgggaaatataaaataagaatgattttttttttatatttgaaaactcaa

SEQ ID NO: 631 - DNA, 50 bp, Homo sapiens
gaaggtgggcgttatcttccgactgatccagctggtggtcctggtctacg

SEQ ID NO: 632 - DNA, 1024 bp, Homo sapiens
ctttatctttgcccctgtgacgggtggcctgtggtttcctgccaacaactcctgtttccggaggcccaacaaggcccacgcagagccaggaggggcagtggggctgggcctgggtggccccaccagccccgccccatctatctttgggaatttatttgtccatgggcgaggctggcctgcagtctgttgccttccaggggccaagagctgctctgatcacccagggattctctctccaacccaagtgcctccagctgacctctggctcctgtcctctggctccacctgcaccgccctgctcttcctaaggggccaggaagcccccagaagctctaccatcgacgtgggtggtggcacccggctcaccctgagagcagaggccgtgcagggggctcagttctgagccccagccggcccaccatggcacggcggttccaggaggagctggccgccttcctcttcgagtatgacaccccccgcatggtgctggtgcgtaataagaaggtgggcgttatcttccgactgatccagctggtggtcctggtctacgtcatcgggtgagtccgggcgcctcccgctgcctgcaccagcccctaccccgggcctgtcctccagactctgacatcccttgcgtgacaccagcgagcccctcttcctctccatccaggggaaggccttcctggcaagccactgtgcgagaatagaaaatcctgccaactcgctgttgagatggggacgaggccggaggggaagccctgcccgggggccttcggtgaacaggaggcagagtctctgggttctgaggagccggctcagtgttatggttcctttgagtggttagtggtgttcagggccagggcaccaccaaccacagccactgagtcctcgacctctgaccgcctgccaaaccaggccgccactgacacacagaggccataccccacacccgtcaccccatatgacaagttagagagagacagactctgctgccagcttccctgcctgagcaagggacatccaggga

SEQ ID NO: 633 - DNA, 50 bp, Homo sapiens
cggcttagcaattggccctgtgacttccagtcacaaaagaggaaggtgtt

SEQ ID NO: 634 - DNA, 1024 bp, Homo sapiens
aacaagaccctgtctcaagaacaacaacaaaaacattgtggactccccagctcaagacacagccccccaacaaacacacatcccccaggctctccagacctgctttgtcccctagtacagaagaagccaagcttgagggcacccctaggactgcgggcacttgaacattctcgtaggtgatttccccatcatcatcagcccctgggtctagagagaagagaaaagggaccaaggtgggatttgggaatgggatctgtggggcgggaagtggggatgcaggatcaaggggaggcctcatcccccttaccctgtcctaaccggctggagatgctcttcttcaggggagccttcacaaacctcagatctgcataggtgatggcctcagccatggtcctgagcagctctgcccccactcgtcttccctgtcatccactgtcctcccttgcccctctcgtctctgtccgtttacaactaggctctgtgttccctctgtgactgcacggcttagcaattggccctgtgacttccagtcacaaaagaggaaggtgttagcaagtctcaaacagatgggctcaatgaagcagaaggcatccctgggccagggccagaggggccacggaggggacgctgaggtccagaacacaggggtaggggatgggcctgtccccatgtcctccctgtgcttcctctccatgcatcttaaacccatatgggccatgctgggccccaaactcggtccttctggttatctgccctgatctgccccaccctcctcctggctgccttgtccactggggcttatgatgtgtagctggagctgcactgacccagacgatctccccagctccagggtgaggctccgttctccccatgagactgggggttcctggtttgcatccctcgcttctcatcatcctgggggttccagtaactgggggttcaggaacaggcctgggccagaggtgaaggtaaggaagagccatggctgcagcacctctggaaaggcaagtggcagcactgcccc

SEQ ID NO: 635 - DNA, 50 bp, Homo sapiens
ttgcttctctgaagcggtgaatgccctggggctggggacgcacaggctcg

SEQ ID NO: 636 - DNA, 1024 bp, Homo sapiens
taataaatgtgtgtcgggttaagataggcccaaagccatttcaaatgtccaggcagtggtgtaggcaggggtcagctctgaagctggcctcctctcattcgggagacccctcagaggtcccagcctccaggatgcagtgttcagagcaatacttctcagtgcacgtctggctgtgtccctgcccagcgctcccagggtcacccctctctctagactcactttctgccccgtcaccccactgtacacccttggtcccagccccttccagtggctcagcttcctgaacactccaagcctgggctcacctctaagccgttatctatgctattctctcagccaggatgcccttcccatacccaaacaatccgtgctcacctttaagactggctgaggcatcacctcctctgagaagccacctctcccaaacctgagcccagatgagccaaagcccttccttcctccagtcagcctggatcctctcatccggcagaactgtcgccttgcttctctgaagcggtgaatgccctggggctggggacgcacaggctcgctggcccacaaccaaagccgcttcctctggaggaggaagtccaggggtgccagggttccacttgctttcttcttcacccagcctaaagggcaattttcccacattccctcagaaccaggaagttcccccattcacactgagcctgttcatgacaaaaaaaaaggtctctccgatttcctctgctcaaccagttccctggctacctgaggccctgcttcacctggaggaagacagtggtaagtttccagcatctccaccacacctcagcgccagaggaccctcagcctccctcgcacacctctgggcagtttggtaactcatcccatctcctcctgccgcttcatcctctaagccctccccagggaacccaggaggcgtctggaacctgttggggacagtccctcacacctgccccattgagtaagggttcatgtggatgcccatcctcccccaggagtcccaaatctaagacac

SEQ ID NO: 637 - DNA, 50 bp, Homo sapiens
cggccacccttgcagtcccagggccaaccagctccagtgaggactaacgg

SEQ ID NO: 638 - DNA, 1024 bp, Homo sapiens
agatggtgaatggggggaacatggtcaagaccaggaatatggtcaaggggggaaagatggtcaaggggacgcagcaaatgcaaaggccctgaggcaggagcagcttgattcacccccaaaacccgtggggcccgtgcaggcgacgggaaggacaagtgtaaacccttttccttgtccctgcaggtgtgtgtgaacatgagtctgcccatgtttacaccctgcaagcctgaagagtccccagaaactgaaagaagaagcaaagccctttctgtaccctccctgccccctgtcccgaccgcgacaaaagcgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgagtagctggtggagggcatcccgtggggggaatacgggagggacagcacggccacccttgcagtcccagggccaaccagctccagtgaggactaacggggcagggtcttgggcacctggtccctggtctttgagcctggatctacccctctgatccctgggaagacagttcccttggacccgccctgggccccagccctttactgtccccgcctgtgtccccagccaggccctcagccttagccaggagtcctctttctgctcccctgccatggccaggcagcccagcgctctctcaggtccgaggcccactcctccaggaagccttccctgactagcccagctatcagagagtggccctcccaagagggaggcctggaaactaaagctctctctctccccagctgcctgtagtgtcagttagagtcttatcctctccagtagggtgacaccatgacaggggccaatagagtcctcccatctgtccccaaggaggctggacaaatgcctgctcagacacacaagtccactgggtcccctaatcccataggaaggccagggaggaactacatt

SEQ ID NO: 639 - DNA, 50 bp, Homo sapiens
atgctccaaagctgtccacaaggcctctggtacaggcttccaggtctacg

SEQ ID NO: 640 - DNA, 1024 bp, Homo sapiens
ccaaggtgggcgtatcacttgaggtcaggagttcaagaccagcctggcgaacatggtgaaaccccatctctactaaaaatacaaaaattagccaggtgtggtgtcatgcacctgtagtcccagctactcagaaggctgaggcaggataatcgcttgaacctggaagacaggttgcggtgagcacagatcgcgccactgcaccccaacctgagcgacagaacaagacttcataaaaaaaaaaaaaaccccacgcagattgcagattcctgggccccatcttcgcctttctgaattgcagcctttcaccctttaagaatgagagggtgaaatctgcacgtcatacaaatagcccaggggctattaatctgatgttgctccccagctccctccaacaccgtcagagggtgcacggattaggcctctgctgcgtgcagagaagcatcctaggtgctgcgtggctgtgccaaagcagcagaaaccggtggtgtgccttaagatgcatgctccaaagctgtccacaaggcctctggtacaggcttccaggtctacgtctcggcttccccgacagtgtccatgcgacactgtcaccagtttctcctctcacaagcagaaaatcaaattcggattgggcaaatgattccctgcccgggtgtggaataagggtcaagtcctaagtatggagagagagcgccggctcccgccaggatatgcgaagctctggaggggaggccaagccaccaggcacccggcgggagaagaggaggctggagagcgccgcccagtgcctgcaggccgggcgctccacgcctcccctccctcctgcacaccccattcccctccggttgccccgcctgggaagccccctccccacacctcccggcccagcatctgcacgagagccgcgagccctggcccagagctctgggtgggcctctcaccccagacggcggccgcagcccgtccctgatcaccggccgcctgagccctccgttcgctcggcgcgagcgccgccacccgtccttac

SEQ ID NO: 641 - DNA, 50 bp, Homo sapiens
tgatctttcttctgcttagtcggcgaactggggtctggttccctctctcg

SEQ ID NO: 642 - DNA, 1024 bp, Homo sapiens
tggaagcgggcaaaagttggatcgatctggaagtttggagacgaagaggaaaaagaaagggagggggaatcctgcaggcctgagcagcggagatcccaaaagccctcctctccgaatagaggctgtcccctaggagacccccgggctcgcctcccggcgggcgcgactccgggaagggccgggaagctcacttacttcggggctgaagctgctgctttgggccgagccgagggaggcgagcgcggtgccgagcgtgagcagggggagcaggagacaacgggggggtcttggggcgggagacatggtccgagaccaccgggtcagccgggcagtgtgggctccgcggccgggcccacgccctggggtcgcaccgccactccctcggggcgcctttgtcttcggtaggcactgaacttgaattcctagaccgctgtcggcttggagttaaaggggattgttcctcaaagtgcctgtttgctcttctcctcttttccggtttttgatctttcttctgcttagtcggcgaactggggtctggttccctctctcgctctctcctctggtccctcccttctcccacagcctctcctccgtccccgccccagtgccctcctttcctggttggggacgtggttgttttagcctgaatccaattacaaccaagaactggaaggaaaaaaaaaaaaaacacctctaagttgcctttttgtggtgcaggctgccatctgcaggggttgaggccgcgatggacagcagggggctgtagggggatccaggggacgggatgtgggagactttgtccctataagcatattctgagtggcttgattcctctggtattcagcatttgtctcacctcagggtgggaattattgggggctatgtggctaggggcaacgaggagctcagagtgtgggatggtggtggggtcttcttccatgcccatgagacctgcagagggagaaggggccagtttactaatagggggttatcttctgggccctgtagacaactgtctatgtcc

SEQ ID NO: 643 - DNA, 50 bp, Homo sapiens
cgctggcctgggacagataggctaaatcacccatgaatctgttctgatct

SEQ ID NO: 644 - DNA, 1024 bp, Homo sapiens
atatggttatcctaatcatagggcgtaaattcttggtgagtatcagctaccttttctgagaggtgctggcaggcactgggtggggtcctgtgcccacacacaggctttggtctgcccatgcttgctcgtaaccacacctgtctggactctcccaacacacactggcactctcacccctgcctggctcctggtgtcccaccgacactctcccatgctccaaggaatccgtgaccgaggaacgcggggctgcccctgcaggaggagggtccggggcagggcccagggagagagctgccagaaaggctggagggtggctgccagcccaccatggtgaccctcccaccccagctgcccatacctgctattctcaaacacagtgaccaggttggacacagatgccagcttctcctcacttgcccccttcatcctgccggtttccggggtggatctcagctaccctcgaagcagagagagaggcctccagccagcacactcagccacgctggcctgggacagataggctaaatcacccatgaatctgttctgatctttcttgagggctcagaaggtcggctcttggcttcagagtgaagaaagaggaagtggtcccagagccacagccctgcaggggaaaggccagcactcccgcagtgggaggagcctgctcgggccccacctctccctcaggggggctgacctttcacacctgtagacccccattccagaagccacctaagaggtggcaacagggcccagaggtagcttctggagcccagtctgggctggtgcagtggtttgcacctctaattccagtgctttgggaggccgaagcaggaggattgcttgagcccaggagttcaagaccaacctgggcaacatagtgagacaccgtctcttaaaaaaaaaaaaaaaaaaaaaggccacccggagccagacccttggctggtttcttggcctagtggttccagccaaccacactttctccttcagaaggtccagtggcttttacttggcctctttccca

SEQ ID NO: 645 - DNA, 50 bp, Homo sapiens
cgggccaccacacttacagccctctgcatcgtcgcctgcaacgagtgcag

SEQ ID NO: 646 - DNA, 1024 bp, Homo sapiens
atgagaccctctgagctcatttccttggggccattgacctatccatgacacccccatgacctctagctcttctgagaaggctgtccttggaatccagttcacagcaaacaaagccaaggagtggaccactgtaaacagggaggaaggcctgatcagatggccagtgtgctcccctggctcacctgcagcatatgagacacgtcaaagagcgagcagtgctggcgtgtgtgcaggtgcgagtcagtgtgactgtcccggtactgcactggcagactccaacccgcaaacgccaccattttcccgccgtgggccaggtggaagtcatagagcggtgtcctgcggagcacctcctgtgggcggctgggcttagtgccaccagggccctagcccccagccgcttccctcccccaccctccaagatcagcaccctctatcccacctgtgcgcaactaagtggacgacacaaggccggggggaatgcctgcaggcgaaagcccagacgggccaccacacttacagccctctgcatcgtcgcctgcaacgagtgcagacggcgcacagaggccaccacactgccaggcacgccgggagatgtagtccaggcctctgctcggacaggtctctctccggagcaaaggatctgaagggggcgtgggcagccccaagggcaggctgggatttagagcagagaatgcaggaacccgcaaccacagggaagaagcctccagctctttcggctgactcttcagggcagctcgggcaatccagagctgattgggctgcccagaacaaagctaggggctagaccgccccctgcagaaccgccctgtctccagagggtcaaagttctggaaagggctgaaaggtctgaatcatacctttaggacctcaagagagtaaggtcaagtgggggtggggaaggtgggccagcctggcaggtaggcagcaccacagtagtctgtcctcatgtggacccctagttccacagctctcccaccaggcagacacaggcagccagcagtca

SEQ ID NO: 647 - DNA, 50 bp, Homo sapiens
atacggatgcggctgtggctgatggctatttggatgctgcccaagcctcg

SEQ ID NO: 648 - DNA, 1024 bp, Homo sapiens
caagttcctcccacctctgccttttcacctgcttgcttttaaatccaccagttagagctctccagaggaaacctaactggataaagttgctggcccaaaggtccgttcctcccttccctctccctgttctccctgatctccgtgtgtgtgtgtgtgtgtgtgtgtgtgtgtgtgtgtgtgtcctctaggcaagctgtgtaccacccagggtccgtaagtactaaaaactcttaaactttcacaccgctgtgttattgaaaccatgcctacaatccagtccctgaggcgaggccaccctgaagggacagactcatgcaggcggatcccctggtcttgctcttctgtccctgcctctggtggctgctggggaacagtagctaccagctaagttgatagagacactcgaagaggttcattcaaaacactggtccccgagcagcccagtaagcttttaaacgcataacattttgtttgggtctcaaacaagtcacaaggcacggatacggatgcggctgtggctgatggctatttggatgctgcccaagcctcgcagtaggaagcagcttcagactgcagcagggccgcatagcccgatagccaggccctggggcacccagggcaccagcaagacgcacagaaacgttttgaaaaacattttaatatacttaaaaaaaaagtaaaagggaaaatcagaagtctttggaagtttcctactgtttttatgtcccatagcaaatccgaggaggacgccccaaactttcagttccctggggttttgaaggtgctcattgggtcctggccacccggccttctcagaacctgggccaggaggctgagctccgcgcgggggtggagggagaggaggaggttcctgccgaggtgcggctgcgcggtgcgggagccgggagcctgggagggcaagggcatcctgaggggcggggccggggggcggagccttgcgggctggagcgaaagaatgcgggggctgagcgcagaagcggctcgaggctggaagaggatcttg

SEQ ID NO: 649 - DNA, 50 bp, Homo sapiens
cggaaagggaatctaagctcaagcaggaacttgaaaaacgtgcatttggc

SEQ ID NO: 650 - DNA, 1024 bp, Homo sapiens
agaggatacagacattagtaagagacaaggaggcgactgcactacagcaatgtcctaggacaaattctaaccctgccatctaaccctgtttagaggcaaatctaaccctgccataagtagagaggacagggtggtggcagaggtgggaagagtgttgttttgcccttactttaagtgaacctggacatgtcctgacctttgcaaacaccacccctcccccgtagttcccacttacctctgcagtgggctgtgtccaagctgctgaggtccttgcacaggtcaaatctaagttctcttccctttcagcccccgctttggtggctgttgctgctgcggctctgctgcaggctaaccttgtttttgctcgggtgggaggctggccatggtgatctcattacagagctgcgtactggctcggaccaggcacgtgatgaaaaaagtttgggtctgtgtgggctggaaacaaaacacccttctttccagagggcatgtccttaaagcggaaagggaatctaagctcaagcaggaacttgaaaaacgtgcatttggccaaactctgggcttccctccccctgccccctttttttcttttaaaaaattttctccatcatctgcaacttaagaaaatgtcgctgtcccataggaggaggcagattcaagaaaagatgtgggtgtcagataatggcaggtagtacaagttgataaaaaggtgacagagaccagaggatctcattttcttttttttcattgcttcttttcctgtggagggcaggcaagggaggagagatgcatcagctatttctagtgagtctagatgcaggaaaggcatgcctgtggagggtaaatttgcactgtgattgaaataggggaacttaggatacaggacccatgacatgaagtgaggagcactttggaaaaagagctgcttttaaatttctgaaaactttttaaataagcaaatgtgcaaatgatataaaatacaatagggtcaaaagaatgtacaatgaaaagtctttttttaatt

SEQ ID NO: 651 - DNA, 50 bp, Homo sapiens
aaaaggccttgaagagcaactgggcacctggccgcgtcaggtgggagacg

SEQ ID NO: 652 - DNA, 1024 bp, Homo sapiens
gcccccatccctctttccgcccagggatgctgaagggagctcgcccacgttctgggttgggcctgctggagcgcaggcagcctcctctagaggccgaggccagaccagggctgaacacggcccggcagtgcgcagccgtcctacgcttctgaggcctccccgacggcccagcgcctgtaagctctcacaacctctcaagtcagatccatgcccctagggaggggcagggacggtgcttggcccagtggacggaagggcctaggggacgggccctgagggagctgggcacactgctggctcccacggcccatggcagccccagcacccagcagagccatcccccgcttctggccacttgaaggtttatctgggtctgcagggcccctccactgtggcaggcacaatcccaccccacaacccacctctgccgcacaaaaaccctcgaggggcttttcctgagctttgacttctgtgaccctggtcctggaaaggagcacctgaaaaggccttgaagagcaactgggcacctggccgcgtcaggtgggagacgctgggcaggacagacgcacaggccatgtgtctggagccctcagatgagtgtgacacctggtcctacagaaaggctaacagggcaggacctggtctccaactgcctctcctcctctgaccagccgtcccacccccatgggccccagccaggacttcctggggagggaggggccatcagccggctggaagccaccagctgtttgtagcactgtgtgccgcttcccggggtgggggcataatgtgtcatcaatccgtgtttataaagcagccctggatgtgattccacaccctccctgcttatctgcagccatgcctcccaaacaatgagtctctccttcctgtgggaacagccccccatccccccgagtgctccccctcagtctagtagggaaactgaggccccagttgagcctttgtcctcttgatgggcagggagaggatgggtgttactttgtacttatatttattctgatgt

SEQ ID NO: 653 - DNA, 50 bp, Homo sapiens
gggccaatgcagagcccctcaggatggggtgccccgtcaggggctggacg

SEQ ID NO: 654 - DNA, 1024 bp, Homo sapiens
tctgcccattgcctcctgccttcaaccccttcccatccaggggaccggcctcccccaagccagtccccccatctccctcctctacctctctaccaccgccttcaccatcctcagcccagcaccctccccaggagccccggcctccgcctgccacccgagccctgtctataaataactgttcaggccccaccgatcacagccccaccgtgggcctggcctcagcccgccagggcatgctccgaggaagccaatggccccctcgctgggtctcaggccaggagttccagggaggaaaccctgacttcccactgatagcaagccaggagggcagtgggtgggctggcgggttcgtgggcaggcaggcaggcgtccgagggccacgggttgggctggtggaggagtcccggtactcacaggggggacgaggggaaacccttccattttgcacgcctgtaacatccagccgggctccgagtcggtcagatcccctgcctcggtgggggccaatgcagagcccctcaggatggggtgccccgtcaggggctggacggtcgtggggcgggtgcagggctcaggcctgccccctgagctacaggagccctgggtgagccccctcccttgacattgcagggccagcacaagttcctgattttatcgaagggcctgccgctgggagatagtccccttggggtgacatcaccgccccaacccgtttgcataaatctcttgcgctacatacaggaagtctctggccggctggggcaggtggtgctcaaagggctggcctgggaagccatggggtccaggccccctgcccagaggaagctgggactgagagggatgactttgggggctaagctggggagggaggatgggagggagaacgtgtagctctgccacaccactgggaggcttttgctctaacccaacaaatgcctgcttcttttgagatccctatgtagccaacagtcacctcattggggtcagagctggaaggggtggcctcttggggcctccactttct

SEQ ID NO: 655 - DNA, 50 bp, Homo sapiens
cgccagcgcccctacggattagcccccagggatctctgagcctggtatcc

SEQ ID NO: 656 - DNA, 1024 bp, Homo sapiens
cgcgcgtcaaggagcgccgggctctagggggcactggggcccgggggccaggggtccagacgccgcgcgcactcaccttccttgccctgcgccgccgcggccgcggccagcgcacagccccacagcagggcgaagcaggcgcgggctgcctggagctccatgccgcgcttctcgctctcggtccgatccccccgagcccggctcccgcacacccgcacgcctgcacgccggcctcggtgtccgctcccgcccgccggcctgcgcgcaacttctgcccctcctgccccgagtccttaatggaagttgggtgagaaccgactcctgttcattcatgccctgcgtgacgtcaccaacgcccgccctcaggaatgtctttaaaggggccgggctggcacccggaggagagggaggggaagtccggaggggtttggaggaggaccttggggccctctggactcgcgggctccccgcaggccttccaaagtttgagcgtctcaaagcgccagcgcccctacggattagcccccagggatctctgagcctggtatcctcggtggaaacgtttaatggttttgcgctgagccatacccattctgcccttcacctctgagactgagctcaatgcgactgagctcaacgctggcctgaaggtctgagctgaaatggattgggggtccaataagcagttgcctcctaagcagcaggcctgagagagtggcccagaaatagacctggatgccctccttcctaaaacccttgaagagtatatcaagctgctgatggtcaaaaagagtatctctgttcagaagcctataagcctactatgatctgagaataggttcatttcctctgggaatggatcagacatgcactatcttatttattaataattctcatctgggaggcaggggtcatcatccccatgttacagaagaggagactgaggctccaagagcagaaacaacatgcccaaagggtgcacagctcacgggtagtagaagcaggatttgaatcctggtggtct

SEQ ID NO: 657 - DNA, 50 bp, Homo sapiens
cggggtgtacatttgtattgtggagaagaaaagattttgtgccactctct

SEQ ID NO: 658 - DNA, 1024 bp, Homo sapiens
tgtttcaaggctgtgattctcactatactggtcctgaggaaagggcttctgtgaactgcggtttttagtttttattgtggttcttagttctcatgagacccctcttgaggatatgtgcctatctggtgcctctgctctccactagttgagtgaaaggaaggaggtaatttaccaccatgtttggttcctgtttataagatgttttaagaaagatctgaaacagattttctgaagaaagcagaagctctcttcccattatgacttcggaaatcacttatgctgaagtgaggttcaaaaatgaattcaagtcctcaggcatcaacacagcctcttctgcaggtaaagatcattttctaggggtcagagtgaatgacgaggtgaaggatgaggagagggtttatgaataaggcataggtgttttcagttgctggttgtctgattgagtatgtctgggaaacacaagagtcccagaagattgagtggcctgcagatacgcattacggggtgtacatttgtattgtggagaagaaaagattttgtgccactctcttcagcctccactctgcttactgaaacagaggtgagagaaatccactccagttctgagctaaggcgagtgctctgatgcccctgtgttttctgaggctgagtggggctggggttaagagattgagtacagcttctgaaaccatcaatccagatgcagggggtcctgatgaatttgtgagatttgttttttgatcagttagagggaaagagtttgggtggacagtggtgagggtatatttgttggtaatggatggaaatgtaacaaaaggcctttgcaaatgaaagactagaaagtctacaaagaaagtctcttaaatctccaggaaactttttctgaaatcagagaacctattgcgtgttgcatctctgagacagactctgttacgtttgggagtagatgcaaggtgatttgggtgtcatgtgtgatatctcaagtatagagcaaaagagagaaaagaatgtatatagagtacaa

SEQ ID NO: 659 - DNA, 50 bp, Homo sapiens
cggcgaaactgatttgcatctccacgctttacctaaagcccgggctctgg

SEQ ID NO: 660 - DNA, 1024 bp, Homo sapiens
ggagccgagagcgggcggcggagcctgagctggacgcggccacgccggcgcggcggtgagcgcagcccggtctggcgcctgcagctgcggggagcgcgccaggcagagggagcggggagcggggcgcggggcgggcctcggtgtgcgggcggcgtgaccttcccgagcggcgggggaagcggccagcgtcgcagcgcacgtgccgcgggactcggagaatctcggggttgtcggcctccttcctgcagtgcccacctggtgggaacttttgtccttgtttgcccccaagtcctgtcatttggctgcggggctccgcgcctcaggggcgccagtgctgggcagcatggagccgcttgtgaatggagacttgctggctgcccaggagtgggcggctgggcaggggcggtgaacgtttagggtccggccaagaaagttggaagtcgtctccctgacctgttccttgcgaggcccgggaggagacgcgcctggccggtccttggcggcgaaactgatttgcatctccacgctttacctaaagcccgggctctggggactggatggcgagctggcctgcggctcctttagccagaagctgggatcttcccgcagcagttcgtgttccctggtggaaaatgcagcctcatctactgactctcccttccaaaaaaaagttattttccccaagggtcgagaaaagtgggtggtcggcactgttgttcctcagttgcaccctggtgtaatttgagagaggggtcaaaggcgctgaaaagattcttttttctattccaagtgctacagcaagctcataaatcaattttaattcatgctgaacagtcttgcctcctccaagccctgtgtcttctccaagccagagctacacataatgtgaattagctgcccactccttctgagtgaatctgttagtacccatcatcgttttctatcctaataattctaatggctatttgtagaatttatttgtttgtttatttttttgagacggagtttcgctcttgttgcccag

SEQ ID NO: 661 - DNA, 50 bp, Homo sapiens
cggaacagcagttatgggccaggcatacctcccagagctgggaacacagt

SEQ ID NO: 662 - DNA, 1024 bp, Homo sapiens
catttatgcctatgatgaaaagagtggaaatggtaataactggatggtgtcactaaactacaaatactttcaggtaggcctgtgcctttttcagcgggctgcagttctcctgcttggcttgagtcattcgcatttcctgagagctgggtagagggggagttgtggaggagcccattctgaaactgatctgatattgcaaacccatacacggaaaggaagaactgcccatacgtattcgagtcttccaatctgactccgagcccgcatccccctcaatcgtctcttttccccactccccagatcacggtgctgcttggtccccctcagagccatagagaagcagggggtgtggccatggaggggaaacctctgtcaccagagactttactgtacttctccttttgctctcagatgctgccagggtccctgaagagggaagacacgcggaaacaggtaaaaatcattttgcttttattttgcattcaacaagcaagttattacggaacagcagttatgggccaggcatacctcccagagctgggaacacagtggggacctccctggctctctcttaccggtgttacaacaggttgtagacagacccctgtcttgagcatcctccttgccaggcctgctgagtcttctgagagtagggtaggttattggatgcccaggagggaagaaggagccagggaggtcagccccaaggttctgcaaggccctcaacaggcctggactgaggaggtctggacagcatggccctgtcctgagcctctgtgcataataactgctgtccctaacctccaccccaccctcagccttccaattcccgggcctggggccctactcctgtgctccagagactcctggagctccttgaggcagcacacagtcctgctctggaggcgcccatctcccactcatgctgggatgctccagcccgtcccagagcaggttgtggctggagggtgctggcagaggagggacaatggcccggctcctggaggcaagtgttggctgcagg

SEQ ID NO: 663 - DNA, 50 bp, Homo sapiens
cgggacaaaaccctgccaggcatcagaaagctccgcagttcttgagttcc

SEQ ID NO: 664 - DNA, 1024 bp, Homo sapiens
atctaaatactccatttcttccagcctcaagaatagtctaacagagagccgacagagtgagtctagtgggctttccacacatgagtgaccactcttcagttgatatggtcaagcacaccactttacctcctgacctcaggtgcaattagcttccaaatattccacatgctccagtggacctttctaattgtaagcatccccctttggcccccattgcaggtgacactcctgggtgtgtggaaagattatgggtccaaagaacttacagcttcttcctcttgaataaacatggtggcaggcaggagaatcttgttttggttttacccttttaaatatcacatgcttggtgggaatgttagcagaagtatccaggctgaacagacacttttaagttcccctttctcctccttattactcaatatcctgagggcataatagaacttttcttgtctaagtttgcctggtcaggggagggaggtgtggctcactcaaccactgaccgggacaaaaccctgccaggcatcagaaagctccgcagttcttgagttccacatgcagagcagatgcgacagctagaagtgagtagggcccagaccctggcccaggaagatccactaaaggaggccatccttccgccttcttctgcaggagtcaggtaacagctatgcctaggtttcttctttcaaataaatgtgtaattttttatagcaggaaaaaagcaccacttccaaattctggcagcacagactgtgctagctgaataactgaaggaaacgcatgttctgttggaaaatagcaaaagagatgaacaggagacactaaaactcagcctcatggtagccaaaaggatgataagcagataaaaatgtggccgggaacgtgtctgtcacttgctctttcgtaactggataaggcctctcatgtgttcttgttggaacctctggtgccactagcgttaaataacgtcttgcagtgaaaccagaaacaaggttttattgccaacagagctgggcacagatggttt

SEQ ID NO: 665 - DNA, 50 bp, Homo sapiens
cgccccgacccaggctggagcctatccagatagggactccccaggctgct

SEQ ID NO: 666 - DNA, 1024 bp, Homo sapiens
gaggagactcttcggccgccaattgggggcggggagtcccgtctggtgggggccgggcccgcgcagaccctacgattacgcggggccggatagttcctacgattacgcggggccggatggttcctacaataacccggggccgcggagacccgacgtcatctcggggctgaggctgccctaccattacagagcggcccgggggcgcggagcggccccgccacacggggtcagtgtgggcaggggcggcgctgccaaggcccgcaggccgctggaggagggggcgaggggcccagtccggctacagggcctcgagtcccactccgctcgggctccgccaacgctgtaacacgatccccggaaattcctggagaagggccgccccccgcccctctcctggcggctccaggcctcgctgcccgccctcgccaccccctcctctccacccttctgcgttgccccgctcaggctccctcttttgacgcttcaccgggcaccaggaccgccccgacccaggctggagcctatccagatagggactccccaggctgctctcccctgcacctctatacccggctgcgccttcatggggacccttacccagccgaattggtgatggggaatcggagactgctgcgcagcatctggcgatgccaggaaccagcagggaggggaaagggggagagaaggggcccaaggagaggcggcgcttccctcctcaactccaggcctgggaggtgactcatagagtctgccccctctcgcccttctgccctgggaggtcgggggtgaggatggtggaggggaagcgtgcgaagggggtgccagggttagaatgaggtgcccaccgaggagagagacgtctgaagtctggcgtcttttccttcaaggctgctgtgtagattgtgaggtgggagggctgaagatcaagttccctcgagggaggttaaagaagggctaagtggacccggaaactctgctcttcggggtggtctccgctctgggaggcggggactcccctctggta

SEQ ID NO: 667 - DNA, 50 bp, Homo sapiens
cgggggagacagtgtccagggacccagggatccacactcaggcctcatcc

SEQ ID NO: 668 - DNA, 1024 bp, Homo sapiens
ctgagtgggtttcctgccctctctggggccctgctgtgtgatcccgagtgggtttcctactctctctgggcccctgctgtgtgattctgagtgggtttgctgccctctctggggccctgctgtgtgatcctgagtgggtttgctgccctctctgggcccctgatgtgtgatcccgagtgggtttcctgccctctctggggccctgctgtgtgatcccgagtgggtttcctgccctctctggggccctgctgtgtgatcccgagtgggtttcctactctctctgggcccctgctgtgtgattctgagtgggtttcctgccctctctggggccctgctgtgtgatcccgagtgggtttcctgccctctctgggcccacttcctcaatcatgaggcaggtctgtcacccatcaattttccaggcagtgggaaggacccccctctgcacgtttgggatggggacagagtgttcagcctgaggacaggcctttgggggtcagttgcgggggagacagtgtccagggacccagggatccacactcaggcctcatccccgagggctcagccgtgcggttgctgccggcagccaggcctcgacccacccccgcccagatcccaacctcaaaaagtggccgcttctgtccagctccccgctccaggagccccctaccttcaagactggcgtgccctctgggggaggaggggtccgtggggacaaactcccaatggccacagcccctggcctcgcaggaggggtctgacctggcgccggcagctgacaggaaaacgtccggcccactgtcagaccgcagcccggggtggggaggggacatttctgcaacacttccccagcagccgaggccgccgcctcccctgcccgcccgcagaggacaggatgtaaccgggagggaacagcctggacagagaccaggaggtgggatctgaaagtcaatagccccagggctgacagccgggtgggggcagtggaaggccccccacagcctcagaggccaggctggggtgcggg

SEQ ID NO: 669 - DNA, 50 bp, Homo sapiens
gatgatggtctctatgttgcgttccagctgcgacattttgcaagtcatcg

SEQ ID NO: 670 - DNA, 1024 bp, Homo sapiens
cacctccaccccacccagccccattgcccacagcgcactctatctcattttcttccaggcacttattggcatttggctttatctgtgctctttattggccaacaactttactgtgtgtctccctccactggaatagtgggctccccatttaccactacatccctctgcccagaacagggcccgacaaatagcaggtgttcaattgagcaatttcttgaccctgtcgtcctgtgtaactgtgagcacctgccctgtataacaggacactcgctgcgtcttggggctgggctccaggagctcaaatcttccccttgattgctgtagcccatactcccatcctcccttgtcaacccaaactgcggtgaggctgggtcagacctgccagagtccagccctaccttgagaaaattttgcagatcttttcgcaccagctctttgaattccccctggttcagggtgtctgggtgccccagcttcacagagtattggtggaaggtgttgatgatggtctctatgttgcgttccagctgcgacattttgcaagtcatcgtcttgcactctgtctgtgtaatggaaaaccaagagttgggacacttagaagaaaatgctgtcaagcttctttgacacttcctactaagcactcacagaaatagtgggggaagtgcaaaataaaaagaaagcacaggctgcaacttaactgggagatggcctgtcacacacatgtacaaaatgattttttagaatatctacagagtgccaaaaagcaaagcatttgagggcaggaggccccaggggaacatgacctaagaaaatgtgaaagaagctttaaagtaggcagggccaaccaaggagggcttctaggaggaggatttggaaggaagttgggtcagggaaggaaagaaggaatcggcaggcaggcttctgcctggggaagctggcagctcacttaccaaagccgaggagccacacagagtgtttgccagagctgtgcaggctcggcatttataggcagctcctgactggg

SEQ ID NO: 671 - DNA, 50 bp, Homo sapiens
cggtcattgaaacgaatgacactacggcttgcaccaggttgaagcagtac

SEQ ID NO: 672 - DNA, 1024 bp, Homo sapiens
cgtgttcaagcaattttcctgcctcagcctcccaaatagctgggattaccagtgcccacccaccatgcctggccaattttttttctttttcatatttttagtagagatggagtttcaccatgttggccagcctggtttcgaactcctgacctcaagtgatccgtcgcctcagcctcccaaagtgctaggattacaggagtgagccaccgcgcccagctagcttttttaaccttgtagctatcttacttaggaatagaatgggaggcaggtttgtcctacacagttaccagtttgacttcttccttttggctcagtgatttggaggtctcaagatttattttcctttcacaatcacgacatggttgttttacatcattacgtttggggatggtttgtcaaacagcagtagtaattggaatttggaggtgagagaattgagtggggaaagagtggcatggggagaccaaggaagaagcttggggtggggtgggtagtggggacggtcattgaaacgaatgacactacggcttgcaccaggttgaagcagtacctggcaaggagagagaggatacgtggaggctgcgatttggagacagacccaagagaacttcctggatgccatcacccagagtcccatccagggagggtgggtgaggtggaagacaagggatcgggcctgcgccacgatcgtcacgtcccatcgaagctggagcggatccgggcacccggagcccccattccaacccctcccggccccaggcaactacatctcccagcatcgcccgctcgggccgcgggaaaggggaaaaaaaaaaaaagtttgggccaagcattcccggaatgtgcttcctgctggcgcggggcggggggcgggcggggaggcccgggcggggcggggagggcgcggggcggcgcggccggagcccggggcgcgcactcggctcggcccggcccgggccgcagcatggccgagccgctactcaggaaaaccttctcccgcctgcggggccgggagaaacttccc

SEQ ID NO: 673 - DNA, 50 bp, Homo sapiens
gctgactccagccagccaggctatttaaggggcgagctgggccgagaacg

SEQ ID NO: 674 - DNA, 1024 bp, Homo sapiens
ccttctccaacagactgagaggtctctgcagacggggccaaaatctcctccttctgaacttccttcttgcacaagggacagagctgtcctcatccagaagcctgggaggcaggaggaggacaggctaaggatgattttctgcgatagtcttgactctattcatggccttctgaagcagaagcagcctggacttctgcttcacacacctccgtctccccagacacacacccagagggtcagccccactggaagtttccaggggtgatcttgggagtgataaccccagtaattggaggccagcaggtggagataaggtcgctaagccatgataatgcaggaggtgagccaagtaaatgctgggttctgggtcactttacagggattcatggggagttcacggtggaacagacaaaaatctcggtgagtgcatggtaatttcctacatgaagaacccaagaggcctcaagggatctaaaaggtgttgtcgacatacaaattaggctgactccagccagccaggctatttaaggggcgagctgggccgagaacgcagcggctgtttgcgccccttctgcctcccgcgcggccagcaccggtacttgcgagccatgagccgccaactgacccatttcccccgcggggagcgcctgggcttcagcggttgctccgcggtcctctctggcgggatcggcagcagctccgcctcattccgggcccgggtcaagggctcggcctcctttggcagcaagagcctctcctgccttgggggcagccgaagcctggcgctcagcgctgctgcacggcggggcggcggccgcctgggcggcttcgtgggcaccgccttcggcagcgccgggctggggcccaagtgtccctccgtgtgcccacccgggggcatccctcaggtcaccgtcaacaagagcctcctggccccgctcaacgtggagatggaccccgagatccagagggtgcgcgcccaggagcgggagcagatcaaggcgctaaacaacaagttcgcctcctt

SEQ ID NO: 675 - DNA, 50 bp, Homo sapiens
ggtaaatctccctgtgaaggattctcccggagctcctgcttggactaacg

SEQ ID NO: 676 - DNA, 1024 bp, Homo sapiens
gagacgcgagcaccccccagcctggagcctggggaagagggccaggaagaggaggagtaggctaggtaggctgggatgcagaaggtgctgggggccggggagaggagggggagatgggaggaaggcggggggcgggcaaggagtgggctaccagcctagggcaaggactgaggactgagaacggggtggcagggggagggagggaccgagggggcctgcggccaggatggggacagtgcgaggtgaagaagcctgataaatctaaagctgagaaggaaaaggggatctgggactgggatggggtgggggtggggggcgggtggtacaaagaaacggcctgggggaacctcacagctgaaagggccgggagggcaggagggcgctgcgccacataggaccaagggggtaaggtgggagggtgcccgcgccgcggaaggactgggatcatgggcaggcggggagcgaagcgaggcctgggccggagggcaggggaaggcaggggtaaatctccctgtgaaggattctcccggagctcctgcttggactaacgggcccgggcgctggtcccatccggagctacggcggccccgcccgtgtccccgctcctctctgctccgcttctcctgggccctggcggccggcgctgcccggcgcttcctcccgccccccgcctgggccccgcgcgcgccgctcgtccgggtcaggtcgcctcggcccggcccgtctccgctcgctgcgccggcggccgagtgcgactcccccgggcaggccgcccgcccccgcccctcccccgctgcctctcctcctccctcccggccccaccctccggcgccggctgccttcccccaccccccacccgggcgctcgggaccgccaggtcccaaacccaccccggtgagcacttgggggctccgcaccaaggcctcgccggccagcagggttcccgggcgctccctcactctcagggcctaccctggtctcccccacgcccctggtccccctgccgcccctccttccatttcca

SEQ ID NO: 677 - DNA, 50 bp, Homo sapiens
cggccgcgcagccagccaagatttcaacacaggtctgccctatttggtca

SEQ ID NO: 678 - DNA, 1024 bp, Homo sapiens
gccttaatggcagaaggtaggggagaggtgggcgtcacaaaagtgcttggggaactataaagtaaacaatgaaaagcagcacaggaaggttcagacatcacacaggagaagcacagggtgttcccctgggtggggatttaaaacaagggcctcaagttccctgcccttgtctctgggcagaaggggcagataatgctatgatacattttttgtaggtggtgccatttgactgcatttaaccaacaaaggtatgtatcgaaatccacgtggagattttcatggcaaaagtagagcgaattcacaaactgcactgtgtctggcagcttcagacaaaagcaatgggaacaaatcacgactcttgtccagcaattcttcctgttttggaatgatctttgctcaacagcccatccatgagtacagggcccccaaaggccaacaagacagggactctctccagggacaaatgccccgcagctgagagaggccgcccagctatccagcggccgcgcagccagccaagatttcaacacaggtctgccctatttggtcaccatccccgacagtgctgggccaggccatcatgtcacattggggagttttccctgcactccagggggaattctcaaccacaacctctgtatccggtagtggcagatggaaagagaaacggttagaaaagcgtggttcttgcgcaggaaagttggagcaaagaagagttcagaagtgggcgggtgtgtgtttaaaaaaaaaaaagggggtggaaaccccaccagccaagtctgcagaaaaaaaataaatgaagtctgcctatctccgggccagagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcct

SEQ ID NO: 679 - DNA, 50 bp, Homo sapiens
cgggaacaatggggcctgggctggcctgatatctcctcaggaaatgaccg

SEQ ID NO: 680 - DNA, 1024 bp, Homo sapiens
aattggattcttttccttaattgttagaagtatcaaaccccagcaatttaatgtgcgttttaggcatcacagaagagaaaggaggaagccaggtagaaacatctgttacagtggaaacatcagacttacagttttcttgaccctcaaggcttgaacctgcaagaaacataagaaacatgttgattccagaagcttcgatgctcatggagttaaagtgatgtggaaacagagtaaacactcacagagcagaagggtcagcaggactccaagccacatcgtggccccttgggcccacctcggctgcatcctgagagtgaagactgcaggcacagttagttctgccttcgggccatgactcgctcagcagaaggcactgcccacaagtcaccgttgagaaacccgccctgtgaaaagcagaaattgctctggtcacttctcccggcgcctgcagagagaccggctgtggcgctggtcaggtaatggcagccatggctggaaaccgggaacaatggggcctgggctggcctgatatctcctcaggaaatgaccggccttcctgaggggccaccgaacgcggccgctttgtttagtttctttagggaaaaaacaaggcacaagtgacatttgccttggcgttcttgaccctccctctgtctcgcctgggtttgggggcccttctcatggcactgtgaggggattcctccctgcctccagcctccacccaccacccaaagggctgctctcccaggacatccagaaagatctctctgcttttccagtcctccccttcccccatcaaagagggcttttgccacacagcataagtctgggccccctgcctttcttgggctgacttttccccaaaattgcaggtttgtcaaagagacctgctgctggggcaggctgagcttggaatgcagcggaactgaggcgagagaatagcagaggaagtagggggcaaagagcacccttgggcgtaggctagcttaagcaatagcaaaagcaaaagatgtaagatagaaga

SEQ ID NO: 681 - DNA, 50 bp, Homo sapiens
cgggcaccatgataccctatgttctggggattagcagtgaggaatggaaa

SEQ ID NO: 682 - DNA, 1024 bp, Homo sapiens
tagtcagtatatctggctctggggtgaagagaacggccccctcttcaccctcaaacaggaaccagtggttggaggggaggaagtgcctgaggggaagttatggggccccagatactcctccatgccccacttcagccctagcagcatctgcctgtgggaagcagctctccacaccagccaagggggcccccacactcccgcgctgctctgcggctcagggagcagcccacctgctgggtgtgctgatatcaccctcccttcttccccccagtgcccacacccacccaggcccaggctccttcccctccatcatccccttaccagcacctagaaccatccagggctgaaaagtcccctccaaaccacgtggtcagcccagggcagaggaaagggctgggctctggagttgggcagagctggccttaaaccccagctccacctttctgggatgggtgacctagtaaagtccaggcttgaatctcgggtctttacttgggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatggtaagtaaagtgtctcttgcatctgcatagagagagtcctgggagcttaggaagtgatggggaacagtgatgtatgcagctcatgactaggtggacaggcctctggggacagctggtacaggagggaaagggacctcacgggaggcccagaaacctggtaagaggtgaggtattaaggtctgggatggagaagctctgagggtatatttttctgcctctaaaactgttggagagggaatctgagaaagctgcaaccaaccaggaggctggggtacg

SEQ ID NO: 683 - DNA, 50 bp, Homo sapiens
agctcggcatctggagcagttcaaggcagcagcgagcaagtccaaagacg

SEQ ID NO: 684 - DNA, 1024 bp, Homo sapiens
ccctaatagatactgaaaaatgtttttgaaccaatgagacaagtctactgataataaacaggcaaataacagcaatgtgctaacagtggctgtttctggtgagcagaattttgaggtctgttcctttcacttcttggtatttcggttgtttctgtaatgactgtatcttgcttttgtaatcataaaggacagtaaaggaaacttcattttgaaaataatacaaagggattcggggacttcaaaagaaggtgactctcctcgtccactccagagaatcaggaaaggagtgtttaaagacccacagaattcctacaagtgacgttgggggggggccagccagccagggcgcatgccggccagcgagtggggtgggctctgggtccgggagaagtcagatcagtgctctgtacagggccttgagggcaagacgaggaatttcgacttaggtccttgaatctggagagctacagaaagtttgtgagctcaggagaagcgctccgagctcggcatctggagcagttcaaggcagcagcgagcaagtccaaagacgcaggagggagggtggggtggaggagtagagagaaaacagaagccgtctacagaccctttttccctctggggcaactaaacctcaagtgcaggaagcgcttggggactgcccagccctcagctgtgttattattcggtgataggtatttgctaattacttccaaaagcctcccatctgtcatcccacccagactgcgcgcttctaattcctcctaccccacatgctgtgcccaatgaaaagtatggtcagcgagcgaaggtttgcaaggagacagacgagggcgaaattaagccaggcggcttccctttaaatcctcgcaaagcagaagggcccctcactctggcagcaggccttggccaaggggcctttagccctgacgacccggggaagagtctcccaaagcagaacgcccggtccggcgcccagaccaaacgcgggggaaccggaagggcgaggcctccacgtaagtccgcg

SEQ ID NO: 685 - DNA, 359 bp, Homo sapiens
tgtccctgccagaggtgcagcactccgggaatgtccctcactctccccgtccctctgtcttgcccaatcctgaccaggtgcagaaatcttgccaagtgtttccgcaggagttgctggcaattgcctcacattcctggccttggcaaagaatgaatcaacccaccctagatcccataaatagggccacccaggtgagcctctcactcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatc

SEQ ID NO: 686 - DNA, 1050 bp, Homo sapiens
cccacccttccctgacccttaaaagaaccaggaaacagcacatgatctgttggaaggaggcattcattctttcctttctgtgggtgtggggaggggaccacagggcacataccccaccctgggatccagctgagcaggggggtcagagatgacagctcttccggctcacaggccaccggcccacatacagggcaatcagaagaaagaaacagcacaaggaaggcacagagggagtcgttgtccctgccagaggtgcagcactccgggaatgtccctcactctccccgtccctctgtcttgcccaatcctgaccaggtgcagaaatcttgccaagtgtttccgcaggagttgctggcaattgcctcacattcctggccttggcaaagaatgaatcaacccaccctagatcccataaatagggccacccaggtgagcctctcactcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaagtaaggggccaagaggggcacctgcaggcagggcctggggaagagtgggagcagaggggaggagaggtgaagagactcaggaagagcgttgggcaggactctaggagtccagggtccaggtttcagctcactctgtgccaccagggtcccctggtggaaaccatgccccttccccccatccccaccccctctcagcctgaacagactcccccaggtccacatcccctctcccataacccccattgtccaaagaaggtgggagcacttttagtccccctgcacagatgaggaaactgaggctcaggaaggcccaccagccacatgcctcctccagtgaggaggtcaccctcctccctgccagactcagaaccgcctcttcccccaggactcccttctgga

SEQ ID NO: 687 - DNA, 476 bp, Homo sapiens; identical to SEQ ID NO: 591

SEQ ID NO: 688 - DNA, 248 bp, Homo sapiens
atcagcaggtgcaccccatttagtgttcacacttctcttaccgagcctgtgatcctgcctccaatccagacttgaccctggttgagcgcgctgacagaacactggattcgataattaatattgaagttgtggatggaaaccaggttgcccctgtagcacctccggcaagtaaactacagggcaggataaaagacaaagaatggagcatccttcctacatgaattcacatgggtcttgagtccccacaa

SEQ ID NO: 689 - DNA, 1716 bp, Homo sapiens
aatcaggtgttctatgaagagaactagctgagcccattcctccatctccaaaaggctccatagacccaactccaccctccatcctcctcctcaaggagtagtagcttctgacacttctatgaaagttgtggtgtggggagagatgataaggaagaagtttcaatgagggctaagcagagtggatccgcgatcagaggagaaaataaatccatttcagtaaaacccattttattgcagggaggtggagggagggatggcaagcagaggaggggaggcagctgcccaggagagggcagctctgaactgctggctgggaccagctcagtaggaacagatgaaaggaagtcttctgaggcagtgggctcgacgccagtggcctcctgtgaaggcagaacagaaagggactttcagcctcttgtccatcccaactcaacccacaggagggcctcttttcccacccacacactgctgtggagtcagagtatataaaagacccaggaagcctctcccacaaagggtcaggctctttgtagcatctcctccttggggcacttcccatctcccagacctttccatcgttcatccccagccccacctcacctcgggtacacagggccacgcagtgaccaccgcgggaccagggctggtgagcagcccagtatgcaaagttccagcggctgccgtcaacccactgaaagcgtctgcagcgaccctggagaaagcaagaggggaagaagggatggggcagagggaaggcagagaagcagacctggccccgtatctgccagctctttctgctgcccaccgggcaatgggcccttccctgctggaccatgatgggaactgtcctagtcatctgaaatgctgatccacggcaattatcaccatcagattctatgcatcccagtgacaggcttgtccttccagccctaacaaaaggtagaacaagggttgccaactcatcctagagatgaggaaacaaactcatggtcttgttttaattttttttttattttatttatttatttatttatttttgaggcggagtttcgctcttgttgcccaggctggagtgcaatggctccatctcggctcaccgcaacctctgtctcccaggttccagtgactctcctgcctcagcctcccaagtagctaggattacagacatgcaccaccatgcccagctaacttaagttacatagatagtgagagatggaaaggaacttggacccaaacctcctgattctaaatccttagctcttccctgaatgcccaggcagccccctcagtgttgtctgtgggtgtccatctatccctggttcttctggagattatacaggagaaaaacagacaaatctgatgcaagctgagtgctggctgagatcagcaggtgcaccccatttagtgttcacacttctcttaccgagcctgtgatcctgcctccaatccagacttgaccctggttgagcgcgctgacagaacactggattcgataattaatattgaagttgtggatggaaaccaggttgcccctgtagcacctccggcaagtaaactacagggcaggataaaagacaaagaatggagcatccttcctacatgaattcacatgggtcttgagtccccacaattcattccctccctcccctgccacaaccatttgaaggttggagaccaaaatgcaacttctgtttgtaggtggccctcccctcttac

SEQ ID NO: 690 - DNA, 21 bp, Homo sapiens
accaaaaatacaacacttcaa

SEQ ID NO: 691 - DNA, 23 bp, Homo sapiens
ggtaattgttagtaatttttgtg

SEQ ID NO: 692 - DNA, 21 bp, Homo sapiens
cactctccccatccctctatc

SEQ ID NO: 693 - DNA, 21 bp, Homo sapiens
taccaaaaatacaacactccg

SEQ ID NO: 694 - DNA, 24 bp, Homo sapiens
aggtaattgttagtaatttttacg

SEQ ID NO: 695 - DNA, 23 bp, Homo sapiens
ctcactctccccgtccctctatc

SEQ ID NO: 696 - DNA, 50 bp, Homo sapiens
cgctccccaagtgctgaccacgcgcgcccccacggctccccgacagctcc

SEQ ID NO: 697 - DNA, 50 bp, Homo sapiens
agtaggtaaaaacactgatgcactctgcttaccatgtaagcctcttaacg

SEQ ID NO: 698 - DNA, 50 bp, Homo sapiens
cggctccaaatcaaaagctgtggaaggaggtaattagcagggactctaga

SEQ ID NO: 699 - DNA, 50 bp, Homo sapiens
ttttgttggttcctcacgtgggcagaagagtgaatgctcagtccccatcg

SEQ ID NO: 700 - DNA, 50 bp, Homo sapiens
agctgatactgcgtgagtgtggtgttgcacgccctggcacagatcaagcg

SEQ ID NO: 701 - DNA, 50 bp, Homo sapiens; identical to SEQ ID NO: 17

SEQ ID NO: 702 - DNA, 50 bp, Homo sapiens
aaaaccgtacgtctgggaggggtcgcagagcgctgtgttaaccacaaacg

SEQ ID NO: 703 - DNA, 50 bp, Homo sapiens
ccattaccactggctttgttacaatctattacaacaatagcagttggccg

SEQ ID NO: 704 - DNA, 50 bp, Homo sapiens
cggaagggcaacagaacaaaagcagcgtacaatgagcagatggcccgggc

SEQ ID NO: 705 - DNA, 50 bp, Homo sapiens
ggggataattacgaggtgccgggaggtgcccacccaccagcctggcgtcg

SEQ ID NO: 706 - DNA, 50 bp, Homo sapiens
cagagggctctgagcgggctgtgtgccgggcgagaacactgcctgggccg

SEQ ID NO: 707 - DNA, 50 bp, Homo sapiens
cgcagcttatttgtcactgagaaagttcaagttagtgctctaattccacc

SEQ ID NO: 708 - DNA, 50 bp, Homo sapiens
cggggcagctgcctgcactgagctctgaggcctttgaagtggaccagaga

SEQ ID NO: 709 - DNA, 50 bp, Homo sapiens
ttaagggccaaccctgaccacagctgagccgtgtgaagaggctgacagcg

SEQ ID NO: 710 - DNA, 50 bp, Homo sapiens
cggctacaagcttgacaagcagcacacattccgggtcaacctctttacgg

SEQ ID NO: 711 - DNA, 50 bp, Homo sapiens
cggcgtctccaggcctgcggccaagcgtgcttgcccttggtgaccacatt

SEQ ID NO: 712 - DNA, 50 bp, Homo sapiens
ggcgctctgcctgcagctatctccgtgtcaatggcatcctttgatagtcg

SEQ ID NO: 713 - DNA, 50 bp, Homo sapiens
cgccagagtaatgggtaagcacttagttctcatcttgggctgtttgaaag

SEQ ID NO: 714 - DNA, 50 bp, Homo sapiens
cgctaaacggtgccacagttttactctcttggaactgtcccacatgggtt

SEQ ID NO: 715 - DNA, 50 bp, Homo sapiens
cgaggcatcggcccgttttgtgtctggtaagggccagagtcctggttcat

SEQ ID NO: 716 - DNA, 50 bp, Homo sapiens
cgctcactgcttacttaaatggacagttttaagtttcagttttaagctca

SEQ ID NO: 717 - DNA, 50 bp, Homo sapiens
cgtgcaggcattctcactcacactgggcagcccgctgtcgggtctctcta

SEQ ID NO: 718 - DNA, 50 bp, Homo sapiens
cgagctcggcctctggcccacgagtgcgccgccccgcctccccatccagc

SEQ ID NO: 719 - DNA, 50 bp, Homo sapiens
cgcggaccccgcttctgtcacccctaacctcactgttgggtccgggacct

SEQ ID NO: 720 - DNA, 50 bp, Homo sapiens
cggggcacagacgtcccagaagcaaacatgcaagtcacgggagtttattt

SEQ ID NO: 721 - DNA, 50 bp, Homo sapiens
tctatatctgatccatcagcaaatctgttaggtctacctcacacatatcg

SEQ ID NO: 722 - DNA, 50 bp, Homo sapiens
gtgggtctcactcagctgggcgctggggccctggtggagaatggctgtcg

SEQ ID NO: 723 - DNA, 50 bp, Homo sapiens
cggtagacaaatgatagacatttgttgaatcaagctgtgagttggagatc

SEQ ID NO: 724 - DNA, 50 bp, Homo sapiens
gtctttgcctgacaccttctgtgaggtttgcgggcttcattttaaatccg

SEQ ID NO: 725 - DNA, 50 bp, Homo sapiens
ggggttatatatttttgaccaaattcaccattactcatttggcattttcg

SEQ ID NO: 726 - DNA, 50 bp, Homo sapiens
gcgtacacaccctgataaggtgtcaagaacctccgtttgagtacccctcg

SEQ ID NO: 727 - DNA, 50 bp, Homo sapiens
cctgctgtagatgtgtcacagctaaattcttgaatggatttttatcatcg

SEQ ID NO: 728 - DNA, 50 bp, Homo sapiens
gaaccaagcactgcttcctgggagagtgatgtcagcatgactcaaaggcg

SEQ ID NO: 729 - DNA, 50 bp, Homo sapiens
cgcaaacccaccctctatccgggtgagcaccatctagtcagctgccagca

SEQ ID NO: 730 - DNA, 50 bp, Homo sapiens
cgtgggatctctgttcattttggtatattactttgctttctgggctgagc

SEQ ID NO: 731 - DNA, 50 bp, Homo sapiens
cgcatactttcagggagaggcactattcttggctttaagttcatgagtaa

SEQ ID NO: 732 - DNA, 50 bp, Homo sapiens
cggggggagaattaagccaaagaagtatatttatgaatcagcaaatgtgg

SEQ ID NO: 733 - DNA, 50 bp, Homo sapiens
cggcttgaaccctcagcttctacagttgtgtcacccatgtgtctgtttct

SEQ ID NO: 734 - DNA, 50 bp, Homo sapiens
ggccgaggtgaaaccattggtttttaaccttgactactgattaaaatccg

SEQ ID NO: 735 - DNA, 50 bp, Homo sapiens
atcagcaccaaagctttgtctgaacttattttgctactattgttaggacg

SEQ ID NO: 736 - DNA, 50 bp, Homo sapiens
cgactgtggggaatgaataagattacaataaaacctgaggaatttaatgc

SEQ ID NO: 737 - DNA, 50 bp, Homo sapiens
cgagtgagtccaaactccttagaaagttggttgctaaggacttggaaaag

SEQ ID NO: 738 - DNA, 50 bp, Homo sapiens
cccttccccaagttccatacagacccctggattgtatgaaatgcaaatcg

SEQ ID NO: 739 - DNA, 50 bp, Homo sapiens
cggagagcaaacagggctaacacagaaagcccttgtaaaaaacagaacga

SEQ ID NO: 740 - DNA, 50 bp, Homo sapiens
cgaggaaggtatggtagaaatgcatccattaccaagaagaaaagtaatct

SEQ ID NO: 741 - DNA, 50 bp, Homo sapiens
cacatcactatatggaacacgactatactttcaaaagatgaccaatctcg

SEQ ID NO: 742 - DNA, 50 bp, Homo sapiens
cgtgcccagcttttctatgggaaaaattgttcttcagacagagcatgaat

SEQ ID NO: 743 - DNA, 50 bp, Homo sapiens
cgtcattatctggcaatagttgttggatgtgtttgctgccatgccacgag

SEQ ID NO: 744 - DNA, 50 bp, Homo sapiens
cgtaggtttccaagaaagatagggtgacaaaattgcctgtcactccgatt

SEQ ID NO: 745 - DNA, 50 bp, Homo sapiens
cggatttctattcagcccatgcccgggatgcattaggatgcccagaacat

SEQ ID NO: 746 - DNA, 50 bp, Homo sapiens
gggagtggcccagcccggtttgctcagtgaccaggatgtttccacagtcg

SEQ ID NO: 747 - DNA, 50 bp, Homo sapiens
gtggtctggttacatcagcaaacatgttctacaatcaaggtaaaaactcg

SEQ ID NO: 748 - DNA, 50 bp, Homo sapiens
cgagtactaaaaggtcaaatgtgtcaagtctagaactagtactctttttt

SEQ ID NO: 749 - DNA, 50 bp, Homo sapiens
cgcaccatcacaccgtcagcaacttgtgggaccaactccctgcacatctg

SEQ ID NO: 750 - DNA, 50 bp, Homo sapiens
agtacatctgttgacaacatggtttactgaatatgttgagcccattttcg

SEQ ID NO: 751 - DNA, 50 bp, Homo sapiens
tctatcttcatttaacttccagtcctttgccctacagataattcgtagcg

SEQ ID NO: 752 - DNA, 50 bp, Homo sapiens
cggccaaaagaaagacatagaatagaatggtggttgctgagggttggaga

SEQ ID NO: 753 - DNA, 50 bp, Homo sapiens
cggactggagctcgcttgcagacaccttcaaatcgagtggtatttaaagc

SEQ ID NO: 754 - DNA, 50 bp, Homo sapiens
acaaacaaaaagctatctgaaaatgctgccatgctaacatatgaaccacg

SEQ ID NO: 755 - DNA, 50 bp, Homo sapiens
cgaatggaaattcaaagggagaacatctaatgttcaagttgatgtctata

SEQ ID NO: 756 - DNA, 50 bp, Homo sapiens
cgtcccctctaatactatagctgagagcttttaatatgaatgggtgttaa

SEQ ID NO: 757 - DNA, 50 bp, Homo sapiens
cgactggtgttgattctcagtcaatttaaaggatgaaaagggctgtaaaa

SEQ ID NO: 758 - DNA, 50 bp, Homo sapiens
cccagttcttcagagttgtcagggtcactgctctgggacccacggactcg

SEQ ID NO: 759 - DNA, 50 bp, Homo sapiens
cgaaggagggagtgcatgaattcatgtaaggatggagatccacatcccag

SEQ ID NO: 760 - DNA, 50 bp, Homo sapiens
cgagtgtggagctatgattggaacctagttcaggctccaaagccacactc

SEQ ID NO: 761 - DNA, 50 bp, Homo sapiens
cggatttttgagacagtttgggaatagtttatcctgttattatcttcagg

SEQ ID NO: 762 - DNA, 50 bp, Homo sapiens
cgttaggattgctaaagagcattttctaaatatttgagtgtaaaccactg

SEQ ID NO: 763 - DNA, 50 bp, Homo sapiens
agtcattgtgactgaagatcaggcccacccaggcattgaggcctcgggcg

SEQ ID NO: 764 - DNA, 50 bp, Homo sapiens
cggccaggccctcatccaccagagtagaccccagcacgagcaggcgtcgc

SEQ ID NO: 765 - DNA, 50 bp, Homo sapiens
gctttccacggctgtgcgcctcggggctggagcggccccaagtgaagacg

SEQ ID NO: 766 - DNA, 50 bp, Homo sapiens
cgcggcccagggttccgcctggctggcaccacccctggaagggcagcccc

SEQ ID NO: 767 - DNA, 50 bp, Homo sapiens
caacgtgaagaaaacgtgaaattctgtcgcttgttgcagctgacagcacg

SEQ ID NO: 768 - DNA, 50 bp, Homo sapiens
aaacaggatctctgcagatggagctcagtgttatgtgttttggatgctcg

SEQ ID NO: 769 - DNA, 50 bp, Homo sapiens
cgccctggcctgaagggaagagtctacaaggtttataacccagaaccgca

SEQ ID NO: 770 - DNA, 50 bp, Homo sapiens
cgtccgcctcgtccactcctggcatttgggataaacatcctgtctcagac

SEQ ID NO: 771 - DNA, 50 bp, Homo sapiens
ccctgaaatcgaccctaacaataatagaggtttggatttgcatgaacacg

SEQ ID NO: 772 - DNA, 50 bp, Homo sapiens
cgccatcgagagacgcaacatggccctggtgaccctcctggtggagaacg

SEQ ID NO: 773 - DNA, 50 bp, Homo sapiens
ttgtgagtctggagggttcctggagaatggggcctgaggcgtgaccaccg

SEQ ID NO: 774 - DNA, 50 bp, Homo sapiens
caggctactattcctgatggagacccccatttccgtggcggcccctgacg

SEQ ID NO: 775 - DNA, 50 bp, Homo sapiens
tcctgaaagtccctggcacaggacaccactacggggctcagctgggtgcg

SEQ ID NO: 776 - DNA, 50 bp, Homo sapiens
cgcaaccagtatcgctgcagcaacgggaactgtatcaacagcatttggtg

SEQ ID NO: 777 - DNA, 50 bp, Homo sapiens
cgggccagccaggccatggcatctgcctgctgggggctgttttactgctg

SEQ ID NO: 778 - DNA, 50 bp, Homo sapiens
tccttcagtggatttctccctgctgctgtcactgagctccacgctgctcg

SEQ ID NO: 779 - DNA, 50 bp, Homo sapiens
tttttacaaattgaaagtttaccgcagcccagcttgagccaagtctaacg

SEQ ID NO: 780 - DNA, 50 bp, Homo sapiens
ctttatccagcaagaagccagctgtgtggcaagcaatggaggtaagaacg

SEQ ID NO: 781 - DNA, 50 bp, Homo sapiens
ccccgtgggacgtggggcaggcagcgagcttgagtgtttgcgcttcctcg

SEQ ID NO: 782 - DNA, 50 bp, Homo sapiens
cggaaagccccattcacaggatttgcattgatttgccctgatctagtttg

SEQ ID NO: 783 - DNA, 50 bp, Homo sapiens
cggggcagttttgtggccttttgctattgaatctgccagatgtgtccaag

SEQ ID NO: 784 - DNA, 50 bp, Homo sapiens
agagcaagtcaggcacaccatactctacctggaacagctgctaaactccg

SEQ ID NO: 785 - DNA, 50 bp, Homo sapiens
ccctgacaaaacaaactctgtaagctgtgtcagccatgcaaggcaccacg

SEQ ID NO: 786 - DNA, 50 bp, Homo sapiens
cgccttccgtatcaaaacctaaatagaagttgttgttaccgtgtgccaat

SEQ ID NO: 787 - DNA, 50 bp, Homo sapiens
cccactctgtgacgctcagaagatagcatcccctcctaaggaacttgccg

SEQ ID NO: 788 - DNA, 50 bp, Homo sapiens
cgtcattgccaactccaatgcctcaatgcacatggcggggcccagccaca

SEQ ID NO: 789 - DNA, 50 bp, Homo sapiens
ctccctgaggaccagttttttcccctggggagtcatcatgaatcacttcg

SEQ ID NO: 790 - DNA, 50 bp, Homo sapiens
cggctgcccaaccctgactccaggctggacactggagatgatgcagacca

SEQ ID NO: 791 - DNA, 50 bp, Homo sapiens
actcagtgactgacgtttacggtcacacgaaggaatcactacaccaagcg

SEQ ID NO: 792 - DNA, 50 bp, Homo sapiens
cgcacgggctctgccgttcagaacacagccacatcccgtgatctcatttg

SEQ ID NO: 793 - DNA, 50 bp, Homo sapiens
ctgagttttcatcaaacacctgctgagcagctggcacgtgccaggacacg

SEQ ID NO: 794 - DNA, 50 bp, Homo sapiens
ctagagacaagcgatgagctgcactgaggatcaaggatcaggcattagcg

SEQ ID NO: 795 - DNA, 50 bp, Homo sapiens
catctgggtggctggaaacccaagaacggtgcctagctcggctctgtccg

SEQ ID NO: 796 - DNA, 50 bp, Homo sapiens
gggctcgttctggcctgcgctgcgagggctgtgggcactgatgggcaacg

SEQ ID NO: 797 - DNA, 50 bp, Homo sapiens
cgaggtcggtctcccacgactgcccaccatctggccggccaccctgaaag

SEQ ID NO: 798 - DNA, 50 bp, Homo sapiens
cgtgcctgccccgccgtgcacacacctcagcccccgggagacgtgcctgc

SEQ ID NO: 799 - DNA, 50 bp, Homo sapiens
cgcccccactcagtcacacgacactgctctcctggcccactgcggcatcc

SEQ ID NO: 800 - DNA, 50 bp, Homo sapiens
cgctaacattatgctctgtggcaggttgccctgtctgctgtgctcacctt

SEQ ID NO: 801 - DNA, 50 bp, Homo sapiens
cgctggttgactggcagagcaacttctggacccagcagagttcagctttg

SEQ ID NO: 802 - DNA, 50 bp, Homo sapiens
cgtgctccaagaagtacaaagaaaaagtcaaagctacagccgctgacggc

SEQ ID NO: 803 - DNA, 50 bp, Homo sapiens
cgatataaaatgaacgcgcgttcaagatttccttcaactcattgttagcg

SEQ ID NO: 804 - DNA, 50 bp, Homo sapiens
cggtttaccacaccacccttgactgggaaatggggctaagattttaataa

SEQ ID NO: 805 - DNA, 50 bp, Homo sapiens
ggccaggggagcagtgagtcactcagggcgggatgggtgaggggcgtccg

SEQ ID NO: 806 - DNA, 50 bp, Homo sapiens; identical to SEQ ID NO: 193

SEQ ID NO: 807 - DNA, 50 bp, Homo sapiens
cggagcagctgccgcgcctcgaagtcactgaagcagaccacacacctgtg

SEQ ID NO: 808 - DNA, 50 bp, Homo sapiens
acccacagagaagctgccatctaaatagggctgatttcgagttttggacg

SEQ ID NO: 809 - DNA, 50 bp, Homo sapiens
agctcctaggtttgaaaagttctatgtgcgcttgaccggggggccttacg

SEQ ID NO: 810 - DNA, 50 bp, Homo sapiens
cgttagcaaacacatagtagcagaaacacctgtcagaggacagtgtctca

SEQ ID NO: 811 - DNA, 50 bp, Homo sapiens
cgggatggagttcccataccgtagttcagaggcatagggacttctgcatt

SEQ ID NO: 812 - DNA, 50 bp, Homo sapiens
gaccccaggctgccatcttggcgctaacttcttccgaggcagagccaacg

SEQ ID NO: 813 - DNA, 50 bp, Homo sapiens
taaaatctacagtacaccacaagggtcacaatactgttgtgcgcacatcg

SEQ ID NO: 814 - DNA, 50 bp, Homo sapiens
cggaaatcagcttgggggccttctagccctgcagctcagaaaagtgtcag

SEQ ID NO: 815 - DNA, 50 bp, Homo sapiens
cgaggtggatattagcaactcctttagcagggctcaatggcgtcttagaa

SEQ ID NO: 816 - DNA, 50 bp, Homo sapiens
tccaaccaattgtgctctcccaattccaacaaccaaatgaagcttcaacg

SEQ ID NO: 817 - DNA, 50 bp, Homo sapiens
attttttactttctatgtgaaattcatcatcaaatgaggatttgcactcg

SEQ ID NO: 818 - DNA, 50 bp, Homo sapiens
gcccaccggggttgccctggtgttgcccccatctgtagagaagttaggcg

SEQ ID NO: 819 - DNA, 50 bp, Homo sapiens
cgctgttttgctcaggctggccttgggactcctgagctccagtgatcctc

SEQ ID NO: 820 - DNA, 50 bp, Homo sapiens
tctgtcagagggctgttgtgggattataagagcccacttgtgaaattgcg

SEQ ID NO: 821 - DNA, 50 bp, Homo sapiens; identical to SEQ ID NO: 724

SEQ ID NO: 822 - DNA, 50 bp, Homo sapiens
cgaggcgctggcgaagcacgaggccttcttcattcgctgcggaatcttcc

SEQ ID NO: 823 - DNA, 50 bp, Homo sapiens
cgaaagcaagcgagtgaattaggatttcaaagtgccctaatagtgtgagt

SEQ ID NO: 824 - DNA, 50 bp, Homo sapiens
cggcacagataaaaatacagagacaatggttccgacccagagatgaggct

SEQ ID NO: 825 - DNA, 50 bp, Homo sapiens
gtccgcagtaataacaaccaaagacacatattctcaggcaatgataaccg

SEQ ID NO: 826 - DNA, 50 bp, Homo sapiens
catgagaaaacttctttaagaccacctgtagaattctgcaatcacatacg

SEQ ID NO: 827 - DNA, 50 bp, Homo sapiens
cggaagaatgaaaagctaatattattgtgtggcatgatgactgtctcttc

SEQ ID NO: 828 - DNA, 50 bp, Homo sapiens
cgccccaccccagaaccagctagcacccaagggctaggcagcctgctact

SEQ ID NO: 829 - DNA, 50 bp, Homo sapiens
tgctgtgggcctcagttttccacctgttacagagaacccctcgcccttcg

SEQ ID NO: 830 - DNA, 50 bp, Homo sapiens
cgggaatctgtctgtgttacaaagcaactagactcaccctattggcctaa

SEQ ID NO: 831 - DNA, 50 bp, Homo sapiens
cggtcgttgtaaaagagactgtcttgagagtgaaaagcaaatagacatat

SEQ ID NO: 832 - DNA, 50 bp, Homo sapiens
ccttctcttccccccaggctatgactttgcagccgtcctggagtggttcg

SEQ ID NO: 833 - DNA, 50 bp, Homo sapiens; identical to SEQ ID NO: 725

SEQ ID NO: 834 - DNA, 50 bp, Homo sapiens
cgcgcagggtgggcggcttaccatagcaagtgatcctgcgatagggaacg

SEQ ID NO: 835 - DNA, 50 bp, Homo sapiens; identical to SEQ ID NO: 723

SEQ ID NO: 836 - DNA, 50 bp, Homo sapiens
cgccaccccaccttcatccacggactccaggtactgtagggctgggaaag

SEQ ID NO: 837 - DNA, 50 bp, Homo sapiens
cagtgacgtggtggggagcgtgtgcttgtgtagggacagctttccaggcg

SEQ ID NO: 838 - DNA, 50 bp, Homo sapiens; identical to SEQ ID NO: 742

SEQ ID NO: 839 - DNA, 50 bp, Homo sapiens; identical to SEQ ID NO: 726

SEQ ID NO: 840 - DNA, 50 bp, Homo sapiens
acttagagcccaccatgaagcatcttttctgttgcttcactgactcaccg

SEQ ID NO: 841 - DNA, 50 bp, Homo sapiens
ggccttctctttctggatggctggtcactgtctgagtcctgatctgaccg

SEQ ID NO: 842 - DNA, 50 bp, Homo sapiens
cggtatttcagttacactctgttgattcaaaagaaggttgtttgtccaag

SEQ ID NO: 843 - DNA, 50 bp, Homo sapiens
ttgctccagcactacagagcagatttggagcagtcaggtggggaagctcg

SEQ ID NO: 844 - DNA, 50 bp, Homo sapiens
cggtcctcacctcactagatcaccatgactcactgggtagatgggctatt

SEQ ID NO: 845 - DNA, 50 bp, Homo sapiens
cgctattgctaagtaaaacccatgtgttttcagtcatggttagcagcagg

SEQ ID NO: 846 - DNA, 50 bp, Homo sapiens
cgaggacgaatcttgaggcctccactggtctacacggacagaagcacgcc

SEQ ID NO: 847 - DNA, 50 bp, Homo sapiens
cgtgggaaagtaatacagggagggaacagcagcccataaaaagaacgtta

SEQ ID NO: 848 - DNA, 50 bp, Homo sapiens
ctcatcttaaggatgcttattatcataatgctttttataattcctaatcg

SEQ ID NO: 849 - DNA, 50 bp, Homo sapiens
ctcttaacctggtggtctttcactagctttacaaaggtgatacagtttcg

SEQ ID NO: 850 - DNA, 50 bp, Homo sapiens
cgaggctctgcacaggtaaactcaagggttaccctgtgctttgaaacctt

SEQ ID NO: 851 - DNA, 50 bp, Homo sapiens
tcagccccggagggcaggcgccagtccatcagcttgtatgtctgtcctcg

SEQ ID NO: 852 - DNA, 50 bp, Homo sapiens; identical to SEQ ID NO: 760

SEQ ID NO: 853 - DNA, 50 bp, Homo sapiens
cgaccattctcacaagacattgaacagagaataagaggagagaaaaaggc

SEQ ID NO: 854 - DNA, 50 bp, Homo sapiens
aagttcccattagatgactcacttcaggagggcaggaaccattctgttcg

SEQ ID NO: 855 - DNA, 50 bp, Homo sapiens
cggctctgccaggacccaccagccaattccaagtcgagcaaaagaatcca

SEQ ID NO: 856 - DNA, 50 bp, Homo sapiens
actgttgatcctgggagtctctggccttgtatttatgacttatcaattcg

SEQ ID NO: 857 - DNA, 50 bp, Homo sapiens
attctgtctagtctttggtcccatagaaattattatctacatcaacctcg

SEQ ID NO: 858 - DNA, 50 bp, Homo sapiens
acacttctggcaaatagttcatctaattagaaccatgggaaacccctccg

SEQ ID NO: 859 - DNA, 50 bp, Homo sapiens
cggggattccaaccccagggcacctctctggcattcccattaaggaagcc

SEQ ID NO: 860 - DNA, 50 bp, Homo sapiens
atttgtaacatcacaagagttagaagaccccatattgcttgagcttttcg

SEQ ID NO: 861 - DNA, 50 bp, Homo sapiens
cgaggcttgtgctcttggccaccactgtcttctggaattataggagtaaa

SEQ ID NO: 862 - DNA, 50 bp, Homo sapiens
cgagtaaaatgatgatcctcactctatggaagagaagcagagctggcccc

SEQ ID NO: 863 - DNA, 50 bp, Homo sapiens
cgcctggaatttcttgaaacacccttatacatgcataaaactgtaggtgg

SEQ ID NO: 864 - DNA, 50 bp, Homo sapiens
cggtcttgggtggcccataggagattaagaatttcctattatccaagctg

SEQ ID NO: 865 - DNA, 50 bp, Homo sapiens
cggccaggctgcaatgcacatggccgccctcattggcagggtcacatgag

SEQ ID NO: 866 - DNA, 50 bp, Homo sapiens
cgccacaaatgagtaaagcaggtctagcaggcttgtctgttgagttactg

SEQ ID NO: 867 - DNA, 50 bp, Homo sapiens
cgagacacctggggatgagaatgaacatgcccatttccagaaagccaaag

SEQ ID NO: 868 - DNA, 50 bp, Homo sapiens
cccctttttcccagggacccacagaactgtgagcaagaaataaatgttcg

SEQ ID NO: 869 - DNA, 50 bp, Homo sapiens
cggtctctgccattggtaggaaaagtaatggactatttctggataaatca

SEQ ID NO: 870 - DNA, 50 bp, Homo sapiens
cggaataaaaccactgaaacacaatcagggctacgtgcattacctgtggc

SEQ ID NO: 871 - DNA, 50 bp, Homo sapiens
cggatgcctatctgttcctgacccccaaggtccctcaggatctgctggga

SEQ ID NO: 872 - DNA, 50 bp, Homo sapiens
cgcaaatccaaaccatatcagggtttcacagctagagagaaggagtcaat

SEQ ID NO: 873 - DNA, 50 bp, Homo sapiens
ggtgattacagcagatgaccccatctgcctggtgcctgactttattttcg

SEQ ID NO: 874 - DNA, 50 bp, Homo sapiens
ggggttgaccatggctggtaacaggggactctggttggccagtggcatcg

SEQ ID NO: 875 - DNA, 50 bp, Homo sapiens
cgagtttaaccccacttggagccagaaagatgggccaaatcaacaccaag

SEQ ID NO: 876 - DNA, 50 bp, Homo sapiens
cacagactaatgataatctttgggaaatttgggtctaccataaatactcg

SEQ ID NO: 877 - DNA, 50 bp, Homo sapiens
aggttaaaaccaagggctcagactacaggtgtgtgtagcatgtgtacacg

SEQ ID NO: 878 - DNA, 50 bp, Homo sapiens
ttcactgcagatgaaatgggcttctcatgctacctcagttaccagaatcg

SEQ ID NO: 879 - DNA, 50 bp, Homo sapiens; identical to SEQ ID NO: 731

SEQ ID NO: 880 - DNA, 50 bp, Homo sapiens
cgacaatttcaatccagagtgttaagtgctgttacagaggagctggggag

SEQ ID NO: 881 - DNA, 50 bp, Homo sapiens
cgtagtctgacacaggagtccacttagccattgatctgtgtggctcaatt

SEQ ID NO: 882 - DNA, 50 bp, Homo sapiens
gactgaaacttgcaccagttctgaatgcctctaaccttggttgtataacg

SEQ ID NO: 883 - DNA, 50 bp, Homo sapiens
cgaggctgaatgaaatccaattggaactcacttgaacactgttttgatgt

SEQ ID NO: 884 - DNA, 50 bp, Homo sapiens
gtgtcccaggaaaggcccactagtgggtcccggtgtgggacccacccccg

SEQ ID NO: 885 - DNA, 50 bp, Homo sapiens
acagtgagctatgccctgaatgacagacaccatattcacaggcaaaatcg

SEQ ID NO: 886 - DNA, 50 bp, Homo sapiens
cgtgctgtgccctcgatgctccagcacctatggccctgctgaccctggag

SEQ ID NO: 887 - DNA, 50 bp, Homo sapiens
cgaggcacggccacttctccaaagggccaagcttccctcgtcaggcggct

SEQ ID NO: 888 - DNA, 50 bp, Homo sapiens
agagagctgacaagggcatgcacgattaattgcacactcgcacacccacg

SEQ ID NO: 889 - DNA, 50 bp, Homo sapiens
cgtaaagtctgctccaaagatggcctccagtttcgccacagctgttttgt

SEQ ID NO: 890 - DNA, 50 bp, Homo sapiens
cgggaccagaagatcctcaaccccagtgccctcagcctccacagcaagct

SEQ ID NO: 891 - DNA, 50 bp, Homo sapiens
cggctcttcaggtacagagatctgaacttggaaagacctgcctttctaaa

SEQ ID NO: 892 - DNA, 50 bp, Homo sapiens
cggctcgctcagccatcaggtgccccacgacacacaggtggtttgggggt

SEQ ID NO: 893 - DNA, 50 bp, Homo sapiens
cgcccgtcgttcatgtcgattctctcagtcaatcaaaacgctgccacagc

SEQ ID NO: 894 - DNA, 50 bp, Homo sapiens
atgcagcgatgtggccgggagttagcatgaagcgtggttattctatcacg

SEQ ID NO: 895 - DNA, 50 bp, Homo sapiens
cgctgtccgcccttcgccacccaccgcgcctgctgctcaggaatgttcca

SEQ ID NO: 896 - DNA, 50 bp, Homo sapiens
tgtttctctttaccgttcaatgcatatgtgcgcaagccacctctgatgcg

SEQ ID NO: 897 - DNA, 50 bp, Homo sapiens
ggcagagtcatctgcgtggcgcacactgttgtatatgctgcacgtacacg

SEQ ID NO: 898 - DNA, 50 bp, Homo sapiens
gctttctcatttttccgttcctccacccactggctggttatgggggttcg

SEQ ID NO: 899 - DNA, 50 bp, Homo sapiens
cgtacttgcaaagtaatacagaaacgtgactttcggcagctacccaagat

SEQ ID NO: 900 - DNA, 50 bp, Homo sapiens
cggttaattatggaaaaacagcttgttaagcaaatgctaatgtaagaaga

SEQ ID NO: 901 - DNA, 50 bp, Homo sapiens
gttttaataaagcactatcaaaaagacggcacagagtttcggttgccacg

SEQ ID NO: 902 - DNA, 50 bp, Homo sapiens
agaggaatcgtggtgctttgcaaatgtgtatcaaggcctttgaatgcacg

SEQ ID NO: 903 - DNA, 50 bp, Homo sapiens
aagaaatccactaatgagtgttcactagcacaggcacatttatgttttcg

SEQ ID NO: 904 - DNA, 50 bp, Homo sapiens
actgcacatatctttttgaaagacagctttttaaggtatgactcactacg

SEQ ID NO: 905 - DNA, 50 bp, Homo sapiens
cgccaagtattcagcatctctttggaattcatttgtcagcctctctggtt

SEQ ID NO: 906 - DNA, 50 bp, Homo sapiens
cgtcaagctggcagaattttagaggcatctcatttaaattagatctggcc

SEQ ID NO: 907 - DNA, 50 bp, Homo sapiens
cgggtgactcatagagagtgattagaagtaaaaaggttctggaaattccc

SEQ ID NO: 908 - DNA, 50 bp, Homo sapiens
tgatgagttgtgaggcaggtcgcggccctactgcctcaggagacgatgcg

SEQ ID NO: 909 - DNA, 50 bp, Homo sapiens
cgcctaaccagttggaaacagggctgtcctgagccaacacccaggagagc

SEQ ID NO: 910 - DNA, 50 bp, Homo sapiens
cggtagagtctaatttgcaagatgtaaatgcagaaaatagacatttcagc

SEQ ID NO: 911 - DNA, 50 bp, Homo sapiens
cgacggacactaaaactgggtcagaaaacttgggttctaaactcctgtgc

SEQ ID NO: 912 - DNA, 50 bp, Homo sapiens
cggtaccatgatacgtgccgcagaatgttcctgctgcgaccgtaaagaac

SEQ ID NO: 913 - DNA, 50 bp, Homo sapiens
cgcccgcgcctttcccaggctcaaggcctccctgcccaccaggcaggtgg

SEQ ID NO: 914 - DNA, 50 bp, Homo sapiens
cactagtaactctccggtgtctagagttagtactgatggactccctgccg

SEQ ID NO: 915 - DNA, 50 bp, Homo sapiens
cgctgagattgtttgagttgtttttcttaattagtatttcatagctaagt

SEQ ID NO: 916 - DNA, 50 bp, Homo sapiens
cggttaaattaattaatgtcagacttagttgtgagagtaatgaaggcagc

SEQ ID NO: 917 - DNA, 50 bp, Homo sapiens
cgctgggagaacttgagcggggagcccagcaccacacacccacttgcctc

SEQ ID NO: 918 - DNA, 50 bp, Homo sapiens
ctgctctaggaatatatttacatacatgtatttctcctatttcttcatcg

SEQ ID NO: 919 - DNA, 50 bp, Homo sapiens
cggggaatccctccctgccactgtagaggatttatgggttgcccttaagt

SEQ ID NO: 920 - DNA, 50 bp, Homo sapiens
gagtgtatcctctgatgtacactaagagcggacttgaggctaaagtttcg

SEQ ID NO: 921 - DNA, 50 bp, Homo sapiens
tgggagacttgtaattgtgtacctgtttgcattgtttagcctatgcatcg

SEQ ID NO: 922 - DNA, 50 bp, Homo sapiens
cggtgcttgaggaagatgcatctgctcttgacactgacatactcgaagga

SEQ ID NO: 923 - DNA, 50 bp, Homo sapiens
cggcatccgaatattctagccctggcagacctcttagctgctttgttgat

SEQ ID NO: 924 - DNA, 50 bp, Homo sapiens
tcccaatcagtgagacctcaaataatgaacttggctctcatttatacacg

SEQ ID NO: 925 - DNA, 50 bp, Homo sapiens
attcaaagacgcttgctctgaaagcccgaaattcagtctttctgaagacg

SEQ ID NO: 926 - DNA, 50 bp, Homo sapiens
taccagagtgcctgtgctgttgtatcctgacacaccaggtactgcatacg

SEQ ID NO: 927 - DNA, 50 bp, Homo sapiens
cgcacaaaaatgtagaaagaatattggagacggaaaattgtgaatgtacc

SEQ ID NO: 928 - DNA, 50 bp, Homo sapiens
ggaaatcgaatcgtggattcaccaggccggtgctggcacactcaccctcg

SEQ ID NO: 929 - DNA, 50 bp, Homo sapiens
gttgtcagaatttccttccctttaaaggctgaataggccaggcgtgatcg

SEQ ID NO: 930 - DNA, 50 bp, Homo sapiens
ccactacaaaaacagtcataaagagcttaacatactcagcataacgatcg

SEQ ID NO: 931 - DNA, 50 bp, Homo sapiens
cgatgggtaggtggaataacagccccctcccaaagcttagcaacaacagc

SEQ ID NO: 932 - DNA, 50 bp, Homo sapiens
agaatggaaaatgtaaattaagcctttgttttccatcatcattctcatcg

SEQ ID NO: 933 - DNA, 50 bp, Homo sapiens
cgccacctccatgctgtgtttctgtggctggagcttttctgcactggaaa

SEQ ID NO: 934 - DNA, 50 bp, Homo sapiens
tgcctgaggccgcccgctgttcagcggaagagccaacatctgtgctatcg

SEQ ID NO: 935 - DNA, 50 bp, Homo sapiens
cggtccagaaatactatctggtccaaatcagcaagagcatcgcacgttag

SEQ ID NO: 936 - DNA, 50 bp, Homo sapiens
aattaccctcatgatgaacatttccctactctgagtaaagatgctatccg

SEQ ID NO: 937 - DNA, 50 bp, Homo sapiens
taaataaagatcatctggtccaaggatggcaaatatgtggcacaagtacg

SEQ ID NO: 938 - DNA, 50 bp, Homo sapiens
aaggcgcagccaaggactattacacctctggctgctcggacgcatcttcg

SEQ ID NO: 939 - DNA, 50 bp, Homo sapiens
cgggtggctgaatggaaaaacaaatggggcttcacctgtgactcagacca

SEQ ID NO: 940 - DNA, 50 bp, Homo sapiens
cggctcaggagactgaaacatccaaagcctgaattggtccttatatcatg

SEQ ID NO: 941 - DNA, 50 bp, Homo sapiens
cgccccgcacgtactgtgtgcctcgttctttatctgtgttcgtttattca

SEQ ID NO: 942 - DNA, 50 bp, Homo sapiens
cggatagattagttctggaataatgcctgagacacagcacccagaacctc

SEQ ID NO: 943 - DNA, 50 bp, Homo sapiens
tgttgtgggaagctttcccgtgcgctgtaggatgtttagcagcaccctcg

SEQ ID NO: 944 - DNA, 50 bp, Homo sapiens
gtactcttacactcacgggggtgccgggcccctggaacctgcaactcacg

SEQ ID NO: 945 - DNA, 50 bp, Homo sapiens
cggaattttttagtgcaaaatatttactagtgtgaggcagaacattatta

SEQ ID NO: 946 - DNA, 50 bp, Homo sapiens
cgagtctatgtaattaagagactgagaattacactagggacctcctatag

SEQ ID NO: 947 - DNA, 50 bp, Homo sapiens
gtagctaagtaaggggcattcatttctccctttcttgttaaggaactacg

SEQ ID NO: 948 - DNA, 50 bp, Homo sapiens
catacttcaaacataacgtgtcttaaaacaacttttgatctctgtcaccg

SEQ ID NO: 949 - DNA, 50 bp, Homo sapiens
cgcccccgcggggcccagccagatgtcagctgcagttattagcctgggcg

SEQ ID NO: 950 - DNA, 50 bp, Homo sapiens
cgtgtcttgattccacctttagaggctgcccagggtttcacacccgaccc

SEQ ID NO: 951 - DNA, 50 bp, Homo sapiens
cgagcctgtggctttcaagctgtggacatctggcctagctagatttctac

SEQ ID NO: 952 - DNA, 50 bp, Homo sapiens
cgcaactgatccgaggacaggctcggcctcccacacgcccccacccccca

SEQ ID NO: 953 - DNA, 50 bp, Homo sapiens
gtctccttcattcattggcctctgctggggcctcctatgggtgtcttacg

SEQ ID NO: 954 - DNA, 50 bp, Homo sapiens
ccataccacttgtgcatgcatgtgatgttctaataccaattgaagaaccg

SEQ ID NO: 955 - DNA, 50 bp, Homo sapiens
ggcagtgttgactgcgttccataccgggacatccaacacaacatttgtcg

SEQ ID NO: 956 - DNA, 50 bp, Homo sapiens
cggatgccctcgtgggccagctatccccaggcacagcgagacagcgacgt

SEQ ID NO: 957 - DNA, 50 bp, Homo sapiens
ccaccgtgcccagctcttttctttctctaagaatcctctggcattctgcg

SEQ ID NO: 958 - DNA, 50 bp, Homo sapiens
ctcactcccatgctgttacaggtcacctcttgcaggggcatatttgatcg

SEQ ID NO: 959 - DNA, 50 bp, Homo sapiens
aaatattacctattagattggtaacaatgaaaaagacttggcagccgccg

SEQ ID NO: 960 - DNA, 50 bp, Homo sapiens
cgccaacagaggatggccagccccaccccagaggacagcgcacccacggc

SEQ ID NO: 961 - DNA, 50 bp, Homo sapiens
cgttatcagtagttctaaacagccatagtagtcacagtgccagaagtgag

SEQ ID NO: 962 - DNA, 50 bp, Homo sapiens
gccgggcgagctgagatcagacaacaggcgctggacgcatcctaactacg

SEQ ID NO: 963 - DNA, 50 bp, Homo sapiens
ggaagtcagaaagctgctcactccattccactgtgagagggcttgtcacg

SEQ ID NO: 964 - DNA, 50 bp, Homo sapiens
tgtgagttagttctacagcacaatgcttggctgctgtttcagcaattgcg

SEQ ID NO: 965 - DNA, 50 bp, Homo sapiens
cgacttcccagccaagggaaactgtcaccgagggtgggactaaatctgac

SEQ ID NO: 966 - DNA, 50 bp, Homo sapiens
cgcgcgcctattgatttgtttctgaggagagtacaccgttcactattgta

SEQ ID NO: 967 - DNA, 50 bp, Homo sapiens
tctgcgtattcctttctgttctttaaaaatgttaaaccatggggtgctcg

SEQ ID NO: 968 - DNA, 50 bp, Homo sapiens
cgccccacactggggtcacccacctatgagcggatccaggggcactctgc

SEQ ID NO: 969 - DNA, 50 bp, Homo sapiens
ttcctcagctcctgttcttggcctgaaaccccacagccttgatggcagcg

SEQ ID NO: 970 - DNA, 50 bp, Homo sapiens
cgtacagagccttaaaccacatcgtggcggtgccgtctgagctgtagcgg

SEQ ID NO: 971 - DNA, 50 bp, Homo sapiens
cttttccttgctaaatcaattccctaagacatcaggactgtgagacatcg

SEQ ID NO: 972 - DNA, 50 bp, Homo sapiens
ctcatataaccccaagaggtaaattagtataatttaacctacattatacg

SEQ ID NO: 973 - DNA, 50 bp, Homo sapiens
cagaaacctcacactcaattagcgagactgcaaacactctgtattaaccg

SEQ ID NO: 974 - DNA, 50 bp, Homo sapiens
cgcctcccacccctggcaggctgccatctttgccaagcacaggaggtcgc

SEQ ID NO: 975 - DNA, 50 bp, Homo sapiens
atcattgttctctccgtgcagctaggtatgccgcaaggtctcgggttccg

SEQ ID NO: 976 - DNA, 50 bp, Homo sapiens
cattttcccaagggtccaggccctaaacatgccagactaccagtggatcg

SEQ ID NO: 977 - DNA, 50 bp, Homo sapiens
cgcatttgaggagctctaagttgttgaatctaagttgttggatgagtcaa

SEQ ID NO: 978 - DNA, 50 bp, Homo sapiens
cgttgtcaggagcgctggtggtttaggttctccacagacgcaggaaaaca

SEQ ID NO: 979 - DNA, 50 bp, Homo sapiens
cgccaacacagacgaaccccaacacgtggcaaaccccaacacaggcgaac

SEQ ID NO: 980 - DNA, 50 bp, Homo sapiens
tcctcaacatggtatggggttcgctatcaccagcgtgaagatggaaaacg

SEQ ID NO: 981 - DNA, 50 bp, Homo sapiens
cgatgactaatttggttagcggcaacaacaggcttcttgcggcgaggcct

SEQ ID NO: 982 - DNA, 50 bp, Homo sapiens
cggcgtgtgtctttgttgaatgccttattgaggtcacacactctatgctt

SEQ ID NO: 983 - DNA, 50 bp, Homo sapiens
cggccatcctgctttagggatgaattgaaactggaaagagagtagtacca

SEQ ID NO: 984 - DNA, 50 bp, Homo sapiens
tgagaaggggcacccaatgtgcttcctcttggggtgcagcggtgtggccg

SEQ ID NO: 985 - DNA, 50 bp, Homo sapiens
cgcacacacatacttgcatgtggatgcaaacacaattggtgcatgggttt

SEQ ID NO: 986 - DNA, 50 bp, Homo sapiens
cgcatctgagcgtagacacacagatctgagcttggatggtggtcactgcg

SEQ ID NO: 987 - DNA, 50 bp, Homo sapiens
cagaaggtcacacagacggttgcgctgctctctcaccactgcaagctccg

SEQ ID NO: 988 - DNA, 50 bp, Homo sapiens
cgcctaggctcaagcaatctggctctggatgtctttaacttgtgattgaa

SEQ ID NO: 989 - DNA, 50 bp, Homo sapiens
cgcctctcaagagcacgatgtaagggctccaagatgagtttgggcttccc

SEQ ID NO: 990 - DNA, 50 bp, Homo sapiens
cggttaaacattggtatagaaaccagatctacttttaattgaaatcagac

SEQ ID NO: 991 - DNA, 50 bp, Homo sapiens
cggaaaaggagcttgtcttgagaaacaacaaagaattgagctatagtttc

SEQ ID NO: 992 - DNA, 50 bp, Homo sapiens
tgcagttaggactccatagcaggcctgcagtggccctggtgataacctcg

SEQ ID NO: 993 - DNA, 50 bp, Homo sapiens
aggaagcctttaaaggactggacccggaaagcacctactaaagtgtatcg

SEQ ID NO: 994 - DNA, 50 bp, Homo sapiens; identical to SEQ ID NO: 900

SEQ ID NO: 995 - DNA, 50 bp, Homo sapiens
cggtgacagatttctatccaggccagatcaaagtccggtggtttcggaat

SEQ ID NO: 996 - DNA, 50 bp, Homo sapiens
cggtacctctactgctgagtccaaagtcaccgcggcatacccagctcggc

SEQ ID NO: 997 - DNA, 50 bp, Homo sapiens
tgggatggaacggctgcgacagatctccattaaagccagcgcgtcgttcg

SEQ ID NO: 998 - DNA, 50 bp, Homo sapiens
ttcttggacccctcttctttgtcccttcttcctctttatcacccagagcg

SEQ ID NO: 999 - DNA, 50 bp, Homo sapiens
cggccatcaaccagatccttgggcggagggtaggtgacgcccttctcagg

SEQ ID NO: 1000 - DNA, 50 bp, Homo sapiens
cgccgctcatgggcctggtgtgcatgcagctgcgcagagggcctctgcct

SEQ ID NO: 1001 - DNA, 50 bp, Homo sapiens
ttgtgaggaggatggtgtggacaccagcgaggaagacccgacactggccg

SEQ ID NO: 1002 - DNA, 50 bp, Homo sapiens
agagaaactccacgcccactaacagtcattctctatttcgtttgcatgcg

SEQ ID NO: 1003 - DNA, 50 bp, Homo sapiens
cgatcttaagagaaagggcaggagtgtttccttgaccccacattctcact

SEQ ID NO: 1004 - DNA, 50 bp, Homo sapiens
cgcccccggggtagcggctctcgttctgatagacttcatcagtgaactcc

SEQ ID NO: 1005 - DNA, 50 bp, Homo sapiens
cgctgatccagtcaccggggaggggctgactggcagccacacagaggttt

SEQ ID NO: 1006 - DNA, 50 bp, Homo sapiens
cggttcccaatttgaagagtggagacagaagtcaagaaaataagcttttc

SEQ ID NO: 1007 - DNA, 50 bp, Homo sapiens
cggctcagccttattgtcttgcttaatgtctgggtctcagttttagagac

SEQ ID NO: 1008 - DNA, 50 bp, Homo sapiens
tgtgaagcagctagaggcgcgctggaaacctgatgcatgctgctgcctcg

SEQ ID NO: 1009 - DNA, 50 bp, Homo sapiens
tggccacgggtcattcgtggttcccctggagccttgcggtgtatagagcg

SEQ ID NO: 1010 - DNA, 50 bp, Homo sapiens
cgtgaacttcctagaggccaaagtaaaaataaaaacagggtcgctaacat

SEQ ID NO: 1011 - DNA, 50 bp, Homo sapiens
cggaaggtgagtgggcaatgaaatgtccaattttaaaagaaattccacgt

SEQ ID NO: 1012 - DNA, 50 bp, Homo sapiens
cgcaagaatgcacttagttaatccaacaagtatttattcagtgcctgagt

SEQ ID NO: 1013 - DNA, 50 bp, Homo sapiens
tttcaacaacaccactgaaagaatgtaaacggagctggtcgcgttggtcg

SEQ ID NO: 1014 - DNA, 50 bp, Homo sapiens
gaggaagtcctttctggagtctgaccctcagtctgcctgcttcaaatgcg

SEQ ID NO: 1015 - DNA, 50 bp, Homo sapiens
cgaaatcagcggaggcccctgctgagtgagtggacacacccaggcgcacg

SEQ ID NO: 1016 - DNA, 50 bp, Homo sapiens
aacatgagcagcatggacaacgcggtacaacggggcgagagcgccaaccg

SEQ ID NO: 1017 - DNA, 50 bp, Homo sapiens
cgcaggcttggagccatgccagtgacacgcctaggaaagttcacgcaccg

SEQ ID NO: 1018 - DNA, 50 bp, Homo sapiens
cccactatatattggtcccgaatgtgctgagttcagcaaatgtcttgacg

SEQ ID NO: 1019 - DNA, 50 bp, Homo sapiens
cggaagaacacttgtatatgctgacatcagcaagcaaaatgcatacagtt

SEQ ID NO: 1020 - DNA, 50 bp, Homo sapiens
ggcttccggtgaccaggataggaagtgttgcaggccctgccccgagggcg

SEQ ID NO: 1021 - DNA, 50 bp, Homo sapiens
cgccgagctcagcagaaacccgcccagaaggtcaaggaccagcaaaaggg

SEQ ID NO: 1022 - DNA, 50 bp, Homo sapiens
gaggcctggcacggcggcaccggaagcgggtactggtgccctaaggagcg

SEQ ID NO: 1023 - DNA, 50 bp, Homo sapiens
tgcgggcctctcctgccctttgtactccacgaggtgtgaggaagttgccg

SEQ ID NO: 1024 - DNA, 50 bp, Homo sapiens
cgcgctcacagcctccgttcccagacacgcccgggcctgagcccccaggc

SEQ ID NO: 1025 - DNA, 50 bp, Homo sapiens
cggtcatagtcctctggagttgacatcagtgggacctcggtgaaactgca

SEQ ID NO: 1026 - DNA, 50 bp, Homo sapiens
cgctgtccggaactggggtgctccacccacactgtctggaactggcacag

SEQ ID NO: 1027 - DNA, 50 bp, Homo sapiens
cgcccatcatagaagtaccagaacttgagctggactttgctgatttagct

SEQ ID NO: 1028 - DNA, 50 bp, Homo sapiens
cgcggttgcgctaaggggagagctgccttgataagacctcttgggcaccc

SEQ ID NO: 1029 - DNA, 50 bp, Homo sapiens
tggggaagtcgctgctgagaactccgatgccaagcgctgacccagcctcg

SEQ ID NO: 1030 - DNA, 50 bp, Homo sapiens
tgaatggatccagaggctctgtgatgcagaaatctagctacaagccaccg

SEQ ID NO: 1031 - DNA, 50 bp, Homo sapiens
cgtaatgatcttgaggaagaaagaaaatgcaaagggaagtatgaaatagc

SEQ ID NO: 1032 - DNA, 50 bp, Homo sapiens
cggtctaattaaaatagggaacaagaaccaaaaaatcccctagttccagg

SEQ ID NO: 1033 - DNA, 50 bp, Homo sapiens
cggtggagttcggagcaattttttgcaggcaggaagtggatcttacaaag

SEQ ID NO: 1034 - DNA, 50 bp, Homo sapiens
cgggccaaatcatcactgggcagaactaggccatagggtgcaaaatatag

SEQ ID NO: 1035 - DNA, 50 bp, Homo sapiens
cgccccataggaagtagtagaagcggcaggcagctgtccccagcggccag

SEQ ID NO: 1036 - DNA, 50 bp, Homo sapiens
ggccatagtcacaccaacagtcaaacaggaatcgtcccagagtgatgtcg

SEQ ID NO: 1037 - DNA, 50 bp, Homo sapiens
cggcctccttagaatgttttaagaatcggccattaactcctgtgcttgct

SEQ ID NO: 1038 - DNA, 50 bp, Homo sapiens
ctcagctgtgggggcgtgtgctgagcaccaagcagagggagctgagcccg

SEQ ID NO: 1039 - DNA, 50 bp, Homo sapiens
gccaaatgactgtgttggcctatgggtgacctggcccctggctagaatcg

SEQ ID NO: 1040 - DNA, 50 bp, Homo sapiens
ctggatggcagacagtgcgtgcaagcatcacagcccactggaagaggccg

SEQ ID NO: 1041 - DNA, 50 bp, Homo sapiens
ttcttcaaaaccctagtcagatattgttacttcactgaaaactctcaccg

SEQ ID NO: 1042 - DNA, 50 bp, Homo sapiens
tggctgatgtctgctgaacacccgatcattcactcaacagacagctctcg

SEQ ID NO: 1043 - DNA, 50 bp, Homo sapiens
aggtcagcagacggtcaccggggaaagcatccaggcatcttgtcgcctcg

SEQ ID NO: 1044 - DNA, 50 bp, Homo sapiens
cgaggagttgcactctagctgccgtgccagcagtctcgtctgctgtgacg

SEQ ID NO: 1045 - DNA, 50 bp, Homo sapiens
cggactgactgaacttgacctgtgacctctgacccggggagcagagaaca

SEQ ID NO: 1046 - DNA, 50 bp, Homo sapiens
cgtgctgtagaacatgcaagacagcaccctgatgtgggtgaatctcattt

SEQ ID NO: 1047 - DNA, 50 bp, Homo sapiens
ggtcgtgaccctgcctccaccctgtgtaaagtcacagctgcaggatctcg

SEQ ID NO: 1048 - DNA, 50 bp, Homo sapiens
ctgacaagggcagaggcacaagcaggagggtgcagcctgtggaaggcccg

SEQ ID NO: 1049 - DNA, 50 bp, Homo sapiens
ggggatgccggcgactcagtagtaaggcaagtcctgccacctcctggccg

SEQ ID NO: 1050 - DNA, 50 bp, Homo sapiens
cggggcacagttaacttaccccttaggaccaggaagtaatctttgtggta

SEQ ID NO: 1051 - DNA, 50 bp, Homo sapiens
cggcctgggcgtggtcttgcaaaatgcttccaaagccaccttagcctgtt

SEQ ID NO: 1052 - DNA, 50 bp, Homo sapiens
ccacagaccctttctccttcactgattacagaatcataccaagcacagcg

SEQ ID NO: 1053 - DNA, 50 bp, Homo sapiens
tgggcctggtgcttgggtttgctaacttctggttcttcatgtgtatcacg

SEQ ID NO: 1054 - DNA, 50 bp, Homo sapiens
cgacatgggcaatgtggggaaagagaccattgtgtaaatgatctacaatg

SEQ ID NO: 1055 - DNA, 50 bp, Homo sapiens
cgaaggccagagcctgtttgtaaaccattaacaggaataacaagagataa

SEQ ID NO: 1056 - DNA, 50 bp, Homo sapiens
gaccgaggccgacaattcagtcgccacacaagaggtcagaaatatactcg

SEQ ID NO: 1057 - DNA, 50 bp, Homo sapiens
tggggataaacggtgtaacactggggcaggtcagtttccttgttggtacg

SEQ ID NO: 1058 - DNA, 50 bp, Homo sapiens
tttgaggaaaataccttgaaaccgtcggtaggactagataggtgacaacg

SEQ ID NO: 1059 - DNA, 50 bp, Homo sapiens
cgtcttggtgataacaggcacttgagaaataagtttttaaagagttgatt

SEQ ID NO: 1060 - DNA, 50 bp, Homo sapiens
aacacagtgtgggctgatgcaatcagtgtttgctgcccttgggcgcttcg

SEQ ID NO: 1061 - DNA, 50 bp, Homo sapiens
cgggcagattttttcagagcaattgaatgtattcaaagatgtcttaatta

SEQ ID NO: 1062 - DNA, 50 bp, Homo sapiens
gaagctggggcaggtaacacgcagagccgccacgtggaacggtctgtccg

SEQ ID NO: 1063 - DNA, 50 bp, Homo sapiens
ggaggcacttgtagctgagtgagggcatttcctttgtgcagtggtatgcg

SEQ ID NO: 1064 - DNA, 50 bp, Homo sapiens
ttcttgttatctcatttaggactcataactcagttgtgtaagctttatcg

SEQ ID NO: 1065 - DNA, 50 bp, Homo sapiens
actatcactagacatatcctctctttagagaaatcacacaaaattctacg

SEQ ID NO: 1066 - DNA, 50 bp, Homo sapiens
aaggatttgctctccagatgcagctgtgccttcctttgaaatatctttcg

SEQ ID NO: 1067 - DNA, 50 bp, Homo sapiens
tcttgagaaatgtactttagactagcttgagttgacacattacaaagtcg

SEQ ID NO: 1068 - DNA, 50 bp, Homo sapiens
cggtatcagcaattgaagcattacagtaaaagacctccgattaccaactg

SEQ ID NO: 1069 - DNA, 50 bp, Homo sapiens
cggccccttctgaccccatagctggcacgggctcctgaccacaggtatgc

SEQ ID NO: 1070 - DNA, 50 bp, Homo sapiens
tgccccggtggtgcagtcagtggaagcagctgtaatctatggggtcatcg

SEQ ID NO: 1071 - DNA, 50 bp, Homo sapiens
cggtgtcacaagaaaaccttgcagactcgccctcgtagacggtcatggac

SEQ ID NO: 1072 - DNA, 50 bp, Homo sapiens
cgtggtacatgagaaccttactataaagtggctctttaggaccgttctga

SEQ ID NO: 1073 - DNA, 50 bp, Homo sapiens
catgaactctctgcgttccaaactatagattgtgattaattattttgtcg

SEQ ID NO: 1074 - DNA, 50 bp, Homo sapiens
gcaccccagttatctagccctcatcaatttgtgcaagaaggccgggctcg

SEQ ID NO: 1075 - DNA, 50 bp, Homo sapiens
cgcaagtgatttataggcattgtctttgcagccactctatgaggcagaca

SEQ ID NO: 1076 - DNA, 50 bp, Homo sapiens
ccactctgaccttagacaagttacttaattgtctcagtgccttggtttcg

SEQ ID NO: 1077 - DNA, 50 bp, Homo sapiens
atttcatcaactgtcccactaacatcctgtatataccaagcttcttatcg

SEQ ID NO: 1078 - DNA, 50 bp, Homo sapiens
cgctttggaagaaggattaggtaattgtagtacaatcttccacccagttc

SEQ ID NO: 1079 - DNA, 50 bp, Homo sapiens
cggacctcaagtccctgtgctagccacggtagttcttcacaccccgtcac

SEQ ID NO: 1080 - DNA, 50 bp, Homo sapiens
atggcggatatgtatgcaacgcgtgtggcctctaccagaagcttcactcg

SEQ ID NO: 1081 - DNA, 50 bp, Homo sapiens
aggtagccatgctgctaaggtcacagtcactaagatattttttgtcatcg

SEQ ID NO: 1082 - DNA, 50 bp, Homo sapiens
ggttacggggcagtggccatgagcctctgtcggactgacgcaaggagccg

SEQ ID NO: 1083 - DNA, 50 bp, Homo sapiens
aaaaaatagacaacctcccagttgccacagacatgtactgtaagcagacg

SEQ ID NO: 1084 - DNA, 50 bp, Homo sapiens
cgggaaatacacattatgctaatgttgatgacagaatttatttggttgcc

SEQ ID NO: 1085 - DNA, 50 bp, Homo sapiens
cggtgccatcttgtgaaaagggctctgcagcttttaatgtgtacagtttc

SEQ ID NO: 1086 - DNA, 50 bp, Homo sapiens
ggcctacattctgtactttgtgctgaaggagttctgcatcatctgcatcg

SEQ ID NO: 1087 - DNA, 50 bp, Homo sapiens
cgtgacgatgcagatgatgcagaactccttcagcacaaagtacagaatgt

SEQ ID NO: 1088 - DNA, 50 bp, Homo sapiens
cgccagcctgcattttagatggaccataactcaagataggcgttgaagca

SEQ ID NO: 1089 - DNA, 50 bp, Homo sapiens
cgagggcactggacatgctggatttggggagactgttatgcgatctcaaa

SEQ ID NO: 1090 - DNA, 50 bp, Homo sapiens
cagaggaagccacataacctcaaaaggtcaagacacctagacatggtccg

SEQ ID NO: 1091 - DNA, 50 bp, Homo sapiens
caacctgtccactcggttttctgtttctttgagattattttctactaacg

SEQ ID NO: 1092 - DNA, 50 bp, Homo sapiens
cggtgtgatgtgatgaaatcaggattttgtgtaagctagctctcaagaaa

SEQ ID NO: 1093 - DNA, 50 bp, Homo sapiens
atcctgcttccatggagtaaaattccagactgggacaagcgttctttccg

SEQ ID NO: 1094 - DNA, 50 bp, Homo sapiens
cgtgtctctttaaagctgctatgtgaacagcttttacagtcattaaattt

SEQ ID NO: 1095 - DNA, 50 bp, Homo sapiens
tgtatgtccagctggacttggcagaagtacacagactggtcctccttccg

SEQ ID NO: 1096 - DNA, 50 bp, Homo sapiens
gacacatgatcctcgggctgctgctgggctttagctacccagagattacg

SEQ ID NO: 1097 - DNA, 50 bp, Homo sapiens
atttcctatggccagtgttctacagaagtaagactgtgcaaactttatcg

SEQ ID NO: 1098 - DNA, 50 bp, Homo sapiens
ggcttctgactggaggacaatgacccagctgatccttctgacgtcttacg

SEQ ID NO: 1099 - DNA, 50 bp, Homo sapiens
aagaaagaaccctttaaataaagggcccacactggctgccagggagtgcg

SEQ ID NO: 1100 - DNA, 50 bp, Homo sapiens
cggggggccaccgaatactccccgagcgcatactatttacagaagagtca

SEQ ID NO: 1101 - DNA, 50 bp, Homo sapiens
gacgtgcagataacgttgagctgccctgtccccgagccataagcagagcg

SEQ ID NO: 1102 - DNA, 50 bp, Homo sapiens
cggtcacttccaggttttgacgatcatgaataacgtttctgtcgacatct

SEQ ID NO: 1103 - DNA, 50 bp, Homo sapiens
cgcctatcggcccatctccctgctgtccatcaggccgggcccccgcctca

SEQ ID NO: 1104 - DNA, 50 bp, Homo sapiens
cgtcctagacaccctggcctggaaactaggacatctgcctcgggcctgtt

SEQ ID NO: 1105 - DNA, 50 bp, Homo sapiens
cgctgcagcagatggtcttggaaatacaacaggctgcattctaactgctg

SEQ ID NO: 1106 - DNA, 50 bp, Homo sapiens
ataacttggaggcagcgtagatggcgcctggtgactgcagtgtgcccacg

SEQ ID NO: 1107 - DNA, 50 bp, Homo sapiens
cgtcagggctgtggtgatgaagtccagatgttataacttaacagtgtttt

SEQ ID NO: 1108 - DNA, 50 bp, Homo sapiens
ggcctgctgtcccactgccatgctcatctgcatatgtatggtttcattcg

SEQ ID NO: 1109 - DNA, 50 bp, Homo sapiens
cgctaatgccaagataagctaatgctgtgcttcacctggacacagggaaa

SEQ ID NO: 1110 - DNA, 50 bp, Homo sapiens
tcacctgcggaggaccccgtgctggggaggtggtggctggtagtgagacg

SEQ ID NO: 1111 - DNA, 50 bp, Homo sapiens
cgaaggctttgtaattcacagtgataagtgcagttaatatgttatctgat

SEQ ID NO: 1112 - DNA, 50 bp, Homo sapiens
actgcccattttttaaaacttcaaatccaaaagatgtgataaatagtacg

SEQ ID NO: 1113 - DNA, 50 bp, Homo sapiens
ctctcgggaagacagggctgctgtgtatcctgattgtggtggtggatacg

SEQ ID NO: 1114 - DNA, 50 bp, Homo sapiens
gaggggacagtcctgggtccccgccaatccggcccttgaggttgagctcg

SEQ ID NO: 1115 - DNA, 50 bp, Homo sapiens
ataggtgaattctatagccaggtggcctccagaagcttacgaaatgatcg

SEQ ID NO: 1116 - DNA, 50 bp, Homo sapiens
cgccctgcgttgcgttctccacacagcagccacggtgactttgttaaaat

SEQ ID NO: 1117 - DNA, 50 bp, Homo sapiens
cggaatattcaaaaccagatggacagttaggtcgatagataagacagata

SEQ ID NO: 1118 - DNA, 50 bp, Homo sapiens
agtgcgctgctgcgggaggaagccagtgtcttcctggagacggcttcacg

SEQ ID NO: 1119 - DNA, 50 bp, Homo sapiens
cgctttgagattgaagagaacatacactggaccatataggggtcttctac

SEQ ID NO: 1120 - DNA, 50 bp, Homo sapiens
cggcttcctttgatgggagacaggaggagtagaaataagctgagctacac

SEQ ID NO: 1121 - DNA, 50 bp, Homo sapiens
actgagcagcaagtattccttgtgtaccagtctctgttccagaaacaacg

SEQ ID NO: 1122 - DNA, 50 bp, Homo sapiens
cggagaaatgcaaatctgataataagcacatatatagatggcatttaaat

SEQ ID NO: 1123 - DNA, 50 bp, Homo sapiens
gctttatctaacaatttatttaacaaacagttaactagcactgtgtgccg

SEQ ID NO: 1124 - DNA, 50 bp, Homo sapiens
cggaaccctgactttggaggcttcagacatcctgaaatataattcagata

SEQ ID NO: 1125 - DNA, 50 bp, Homo sapiens
cctggtcacaacattcagaggacacacaggtaggattaacagtaaaatcg

SEQ ID NO: 1126 - DNA, 50 bp, Homo sapiens
gccaggatcacaaagtttctgccttatcatttatggttattgttacctcg

SEQ ID NO: 1127 - DNA, 50 bp, Homo sapiens
aataagaagagtccgtacctctttcccctcactctgcacccagaataccg

SEQ ID NO: 1128 - DNA, 50 bp, Homo sapiens
ttcagcagatgagatctcagcaatccccactaggctggcttctaataacg

SEQ ID NO: 1129 - DNA, 50 bp, Homo sapiens
tggcttctgccagagaagccccggacagctgcgagcgctggctgagaacg

SEQ ID NO: 1130 - DNA, 50 bp, Homo sapiens
ggcaggtcttctgacttggtctcattttctgcatggctttctccctctcg

SEQ ID NO: 1131 - DNA, 50 bp, Homo sapiens
cgtggcttttgattatctgcaaagattaatgagccctaatgaacgggtca

SEQ ID NO: 1132 - DNA, 50 bp, Homo sapiens
gtcccactggggcacacagcagagcaatgaaattcctgcatattaagacg

SEQ ID NO: 1133 - DNA, 50 bp, Homo sapiens
cggtagactgatgaaataaggtttggttcatatccataacagttgactac

SEQ ID NO: 1134 - DNA, 50 bp, Homo sapiens
cggtaggtgtgcacaagccagagcagagtcccattccttgcatccgccac

SEQ ID NO: 1135 - DNA, 50 bp, Homo sapiens
cctggcacctgcttcacagccttcccgcttgcctgctttgtggtgagtcg

SEQ ID NO: 1136 - DNA, 50 bp, Homo sapiens
cggtctgatctgaactcggcttcagttggtctggaatgcaccggctgcat

SEQ ID NO: 1137 - DNA, 50 bp, Homo sapiens
cgctgaatcatggagtttatcttaaggatggatctgaatgagatctgata

SEQ ID NO: 1138 - DNA, 50 bp, Homo sapiens
aaattctgaattttcgctacactgtccacagtaccaaatggcaataaccg

SEQ ID NO: 1139 - DNA, 50 bp, Homo sapiens
cggtggctgtttccatagtagcctcatatcactgccaaatctcatctgat

SEQ ID NO: 1140 - DNA, 50 bp, Homo sapiens
ctatctgtgacagataacctatatcacagatagatctatctgtgacctcg

SEQ ID NO: 1141 - DNA, 50 bp, Homo sapiens
cgcaataagcacagagctggacttgaacccaagttttgccacacaggcct

SEQ ID NO: 1142 - DNA, 50 bp, Homo sapiens
ggctctgtgggtttggctcttagagtcaagatggtcaccgcctccaagcg

SEQ ID NO: 1143 - DNA, 50 bp, Homo sapiens
cactaattaccactcagttcttgggctgtagcaaagataatttcaattcg

SEQ ID NO: 1144 - DNA, 50 bp, Homo sapiens
cgcagttatctgtggctgatcatggcttgtcatactgctactcctagatg

SEQ ID NO: 1145 - DNA, 50 bp, Homo sapiens
cgctggtgtgggaccagtctcctagacccaagtgctaggagtagaatgct

SEQ ID NO: 1146 - DNA, 50 bp, Homo sapiens
gcatcctaacaaatgaacaatctttagctaaagacactgaccagattacg

SEQ ID NO: 1147 - DNA, 50 bp, Homo sapiens
cgtatgaggttatgtagcatgtgaggataggcatagctttgttacgtgtc

SEQ ID NO: 1148 - DNA, 50 bp, Homo sapiens
cgctgataaatctcttgagtttttcaagaaggtgacagtgtataccatga

SEQ ID NO: 1149 - DNA, 50 bp, Homo sapiens
cgcggtgacacctacagccacgcaagcacctgcgtaaacacgtgctacag

SEQ ID NO: 1150 - DNA, 50 bp, Homo sapiens
cggcaaccccaaagcacctgttaagactcctgacccccaagtggcatgca

SEQ ID NO: 1151 - DNA, 50 bp, Homo sapiens
ccatggaggagcgtgacggagagatctgcgtgtgacgctgtgtgctctcg

SEQ ID NO: 1152 - DNA, 50 bp, Homo sapiens
ccctataatatctttactgtaaggcagctacttctccctaaataatttcg

SEQ ID NO: 1153 - DNA, 50 bp, Homo sapiens
taaaaaatttcttgccacatacgagtttaaaccaagataatcacggcacg

SEQ ID NO: 1154 - DNA, 50 bp, Homo sapiens
cgctatagcagtttttaaaagcttcttcgattgttgaccggtccgttaag

SEQ ID NO: 1155 - DNA, 50 bp, Homo sapiens
cggaagccaagctctgtcccaagcactgtgctgatgatatctcatttcat

SEQ ID NO: 1156 - DNA, 50 bp, Homo sapiens
cgccgctgcacctcatcctccatgctgtccacctgccaggataaggagtg

SEQ ID NO: 1157 - DNA, 50 bp, Homo sapiens
cgtggaagagggacagaattttagagagagaaactcatttgagaaatggg

SEQ ID NO: 1158 - DNA, 50 bp, Homo sapiens
cgtcgttattcttaggagatgcatgttgaaatatttagaaatgattttat

SEQ ID NO: 1159 - DNA, 50 bp, Homo sapiens
acagggacctaattaactgacagttggtctgattgccaagctgaggggcg

SEQ ID NO: 1160 - DNA, 50 bp, Homo sapiens
cgaaacacagtcattcatgttggtaattgtgacagagattatgtggccca

SEQ ID NO: 1161 - DNA, 50 bp, Homo sapiens
agatggatagtggcttcctaatatccccttttcatcagtgttaaaaatcg

SEQ ID NO: 1162 - DNA, 50 bp, Homo sapiens
tgaggttaagaaatttgctcatggccatacacgcagcaagcagttctacg

SEQ ID NO: 1163 - DNA, 50 bp, Homo sapiens
cggttgcttaagctgacactgcagagcattgcaagaagtgttgattaaaa

SEQ ID NO: 1164 - DNA, 50 bp, Homo sapiens
atttgtattttgacagcccatggtagcatcagataaattgccttttaacg

SEQ ID NO: 1165 - DNA, 50 bp, Homo sapiens
cgcacaactgctccatcttttaagatattggaagtgagagcacgggagga

SEQ ID NO: 1166 - DNA, 50 bp, Homo sapiens
ctccacaataagctaaagccaactcctgcaacaggctcctgtgatcaacg

SEQ ID NO: 1167 - DNA, 50 bp, Homo sapiens
cggtgcctggggctcaggtctgttcaaactcctgctcacagaagcctaca

SEQ ID NO: 1168 - DNA, 50 bp, Homo sapiens
cgcaatcctcagaagctgacaggagcttcagagaggagaattaccttacc

SEQ ID NO: 1169 - DNA, 50 bp, Homo sapiens
atttacacatccataggcctcatttctgctgttctaaagagtctttatcg

SEQ ID NO: 1170 - DNA, 50 bp, Homo sapiens
aactcctaaggccaaaggaatgtggtatgctcactgacttggcttggacg

SEQ ID NO: 1171 - DNA, 50 bp, Homo sapiens
ggggtaaatggatgcagagcaggcttctaaggtgcagtccccctccttcg

SEQ ID NO: 1172 - DNA, 50 bp, Homo sapiens
ccaggtgcaacatatgcatgccagttggtgcatgcagcttgtgaggtccg

SEQ ID NO: 1173 - DNA, 50 bp, Homo sapiens
cgggcagtctgtggttcctgaccagactgctgggggtcaaatctctttca

SEQ ID NO: 1174 - DNA, 50 bp, Homo sapiens
gaatttcctaatatatttctaacagataatggtcaccaccactaccctcg

SEQ ID NO: 1175 - DNA, 50 bp, Homo sapiens
cgattgttaggaaaccaaatgttctgaacattattttcattagaaaaggg

SEQ ID NO: 1176 - DNA, 50 bp, Homo sapiens
agcgggaggctggtggcgtgcatcaggccatgggggtggggcttggaccg

SEQ ID NO: 1177 - DNA, 50 bp, Homo sapiens
cgactgctcaaactgggtttggagaacaacccagtatggcttttacagag

SEQ ID NO: 1178 - DNA, 50 bp, Homo sapiens
cgggataaagcacagctcctccgccagcccggcgcgcagcgggcctcacc

SEQ ID NO: 1179 - DNA, 50 bp, Homo sapiens
cgcactccggtgactcagaattgtcgccgctccgtgcaagtaagtgtttg

SEQ ID NO: 1180 - DNA, 50 bp, Homo sapiens
ggtgatgaacgagaatgagcgctatgacgcagtccagcactgccgctacg

SEQ ID NO: 1181 - DNA, 50 bp, Homo sapiens
agtatctagaaaaacccagagaatgatattccacaaaacggtaagcatcg

SEQ ID NO: 1182 - DNA, 50 bp, Homo sapiens
cgcgggagctgcgggctgcggtgatccagcttctggacacctcctatctg

SEQ ID NO: 1183 - DNA, 50 bp, Homo sapiens
cgccctagggccaagagttgggccccgtctgagcttttttcaactctgtt

SEQ ID NO: 1184 - DNA, 50 bp, Homo sapiens
cccaatagaggctgtctcaacagtggccaacagaactctcatgagtatcg

SEQ ID NO: 1185 - DNA, 50 bp, Homo sapiens
gtagaccttgctaataacttgcctataagttccacaatactcccactacg

SEQ ID NO: 1186 - DNA, 50 bp, Homo sapiens
cgcagagtcttgaccacaaggaaaatcttgtttttgagcaataacccttc

SEQ ID NO: 1187 - DNA, 50 bp, Homo sapiens
cgtcaagctttgttgagtcagacagtgtctgtccaaactactcaagtcag

SEQ ID NO: 1188 - DNA, 50 bp, Homo sapiens
gggcgaagtcgctggtgccagagtcaatgacacggagaggaaacgcttcg

SEQ ID NO: 1189 - DNA, 50 bp, Homo sapiens
tttactgatttaggatgtcgaccatctagtctgccagagctgcaataacg

SEQ ID NO: 1190 - DNA, 50 bp, Homo sapiens
cggcaagtcctattgagattataacaatgacactgataaaaaagaagatg

SEQ ID NO: 1191 - DNA, 50 bp, Homo sapiens
agcacgttcatgacccttgaaagtcttcgaaaacagattactgggcttcg

SEQ ID NO: 1192 - DNA, 50 bp, Homo sapiens
cgtgcactctgaacaagcattcatttggctgcacagggccagatcaaggt

SEQ ID NO: 1193 - DNA, 50 bp, Homo sapiens
actagctttgcgaaagccacagggaagtgatcttggttgtgcaggtgtcg

SEQ ID NO: 1194 - DNA, 50 bp, Homo sapiens
aaatgaatgtagataccatcttagccaggtgatgaaacaaactggtatcg

SEQ ID NO: 1195 - DNA, 50 bp, Homo sapiens
cggaaatcagagggagaagacgcatatcttgtttcagtgagggtgatccc

SEQ ID NO: 1196 - DNA, 50 bp, Homo sapiens
cggtcagaggggaccatctgtttatcttacaggcttaatatgatcacagg

SEQ ID NO: 1197 - DNA, 50 bp, Homo sapiens
taccagcccttcatttctttgctttgactctttaatttccaagataatcg

SEQ ID NO: 1198 - DNA, 50 bp, Homo sapiens
cggaaggctggggaaacaggctctgccctatatctgagggaagtgtgcat

SEQ ID NO: 1199 - DNA, 50 bp, Homo sapiens
cgccaggtttcgagatgaaatctccgccctgtagctccggacgtcctcca

SEQ ID NO: 1200 - DNA, 50 bp, Homo sapiens
cggctaagtccccacgtacgccattaaacaacggtcaaatggtaacatgt

SEQ ID NO: 1201 - DNA, 50 bp, Homo sapiens
ctgcccttggtcagcaccgtgtagggcatgtgctcacccgctggagatcg

SEQ ID NO: 1202 - DNA, 50 bp, Homo sapiens; identical to SEQ ID NO: 531

SEQ ID NO: 1203 - DNA, 50 bp, Homo sapiens
cggcttgagcgccagcagcctgcacaggttccatgagctggagagctgcg

SEQ ID NO: 1204 - DNA, 50 bp, Homo sapiens
cggactacgagtaccagcactccaatttgtatgccatatcaggtatgtgg

SEQ ID NO: 1205 - DNA, 50 bp, Homo sapiens
aatacctggcacgccagggtgatgcaactgggagcttctgcacgttcgcg

SEQ ID NO: 1206 - DNA, 50 bp, Homo sapiens
cagcgcccgtgtgatgatgatgctcacgctccggtgtgacacagacggcg

SEQ ID NO: 1207 - DNA, 50 bp, Homo sapiens
cgggaggagctgggtggatacctttctaacttccgaggctggctactcct

SEQ ID NO: 1208 - DNA, 50 bp, Homo sapiens
ccctctgcccagcgcgtctgggacgtgtgcccaagagcttattgagaacg

SEQ ID NO: 1209 - DNA, 50 bp, Homo sapiens
tcaggaaattgcgaagaaattctgcggcgggtgcaggatgcccaccctcg

SEQ ID NO: 1210 - DNA, 50 bp, Homo sapiens
cgtggagatgaactagaacaggtatgaggttctagcagaagaaacatttg

SEQ ID NO: 1211 - DNA, 50 bp, Homo sapiens
cgatattagaaaggagctcaaggtagtacacttcacgtgccccggtaacg

SEQ ID NO: 1212 - DNA, 50 bp, Homo sapiens
cggcactttcaaccaaacagagacactccggctcgtacacaaccagccgt

SEQ ID NO: 1213 - DNA, 50 bp, Homo sapiens
cgcaatccagtcacacttgtgaaaatgctgaagacggtggttacggaagc

SEQ ID NO: 1214 - DNA, 50 bp, Homo sapiens
cgctgagccagaacaataggacttcttctgtagttgtgaaacttgtcagt

SEQ ID NO: 1215 - DNA, 50 bp, Homo sapiens
gtaccaactgaattcaatttaaaaacaaagatgtcagacatgcatcttcg

SEQ ID NO: 1216 - DNA, 50 bp, Homo sapiens
gtgtatggattcggcatggagccctcagctggcggctctgggtgctgacg

SEQ ID NO: 1217 - DNA, 50 bp, Homo sapiens
cgcacttctgtgcgctcactatgagaagctgtgtttactcgctccgtgct

SEQ ID NO: 1218 - DNA, 50 bp, Homo sapiens
tcccagtcattctcggggtaagttccgaagttggaggtgtcgccttcgcg

SEQ ID NO: 1219 - DNA, 50 bp, Homo sapiens
cgtcctccgtctgccgcccactaatcgttccccatacagacttcctggcg

SEQ ID NO: 1220 - DNA, 50 bp, Homo sapiens
aggtcacagatgcagacgtttgctcgaagtggctgccgagctcagacccg

SEQ ID NO: 1221 - DNA, 50 bp, Homo sapiens
gtggaggatccaattctaagacagctcattcattcacatggctgttagcg

SEQ ID NO: 1222 - DNA, 50 bp, Homo sapiens
ttctcaacaccagttttctgagcagggtgaataactctgctcatacctcg

SEQ ID NO: 1223 - DNA, 50 bp, Homo sapiens
tcctattactccagacgaatctgtttcatgtgctgaagctctccccttcg

SEQ ID NO: 1224 - DNA, 50 bp, Homo sapiens
aaaaccaagtctaggatttttccatggatggtttctcagccgctctcacg

SEQ ID NO: 1225 - DNA, 50 bp, Homo sapiens
ggctgtggttctctgcttgtgcccactttgtgtttgtaaatagcgagtcg

SEQ ID NO: 1226 - DNA, 50 bp, Homo sapiens
cgggggctagagttcataatttctggtaatcgctcaaccctgtgattacg

SEQ ID NO: 1227 - DNA, 50 bp, Homo sapiens
cgctttgcttagagatcaacagagtgacatcctagggtctgagcctcaac

SEQ ID NO: 1228 - DNA, 50 bp, Homo sapiens
caaaagcctgtgaggagctcctggaagacattaagttctctacagcaacg

SEQ ID NO: 1229 - DNA, 50 bp, Homo sapiens
cgcaggagtaaaattgggtaaaacaagcacatgggaactgaggcaatctc

SEQ ID NO: 1230 - DNA, 50 bp, Homo sapiens
cgggtgcaactggcaccaagaacaacacccatgcccaggtgacaactgcg

SEQ ID NO: 1231 - DNA, 50 bp, Homo sapiens
cgtgttcataaatgagtgcagtgatatcaatttaagaacatccatcatgt

SEQ ID NO: 1232 - DNA, 50 bp, Homo sapiens
atgtttgtacacagctgcctccttgactgtagttgattggcctctgtgcg

SEQ ID NO: 1233 - DNA, 50 bp, Homo sapiens
gagacgagcgtctcagacttgaggaaatacacgcgtggaagacgtgcgcg

SEQ ID NO: 1234 - DNA, 50 bp, Homo sapiens
gttcttctccgtgacaggatgttcttttccgtgacaggaagttccgtccg

SEQ ID NO: 1235 - DNA, 50 bp, Homo sapiens
aagtgggatccgcaagatgatggatgagtttgaggtagacccctttcccg

SEQ ID NO: 1236 - DNA, 50 bp, Homo sapiens
tgacgctgtatttcctgaaactgctcagcaagatttccagctatccagcg

SEQ ID NO: 1237 - DNA, 50 bp, Homo sapiens
cggtcagttcctgtgaggaggaaacaatgatactgcattatagacatcgt

SEQ ID NO: 1238 - DNA, 50 bp, Homo sapiens
cggggagggactagatcagaagagatcaagggctctattcaggaacgttg

SEQ ID NO: 1239 - DNA, 50 bp, Homo sapiens
cgtgggcatcacgtaagcagcacactaggaggcccaggcgcaggcaaaga

SEQ ID NO: 1240 - DNA, 50 bp, Homo sapiens
caaatcactgtagttcagacaaaaccttcataccattttattatttaacg

SEQ ID NO: 1241 - DNA, 50 bp, Homo sapiens
ggcttgcgtagtcaaggctgcccgcgtgccacgtgtggtggacagcatcg

SEQ ID NO: 1242 - DNA, 50 bp, Homo sapiens
cgcgcctagctggcactccattcattgcggacacagccgagccctccggg

SEQ ID NO: 1243 - DNA, 50 bp, Homo sapiens; identical to SEQ ID NO: 601

SEQ ID NO: 1244 - DNA, 50 bp, Homo sapiens; identical to SEQ ID NO: 599

SEQ ID NO: 1245 - DNA, 50 bp, Homo sapiens
gcatgggttctgatgggggccctgccataggccgcctggtgacccacgcg

SEQ ID NO: 1246 - DNA, 50 bp, Homo sapiens
cgcacatctcatgaatgccatggtattccttatttcgtgtcagcccttcc

SEQ ID NO: 1247 - DNA, 50 bp, Homo sapiens
cgcacccagccgcacctactcttttgtaaagcacctgtgacaatgaagga

SEQ ID NO: 1248 - DNA, 50 bp, Homo sapiens
caagccccagggctccttgaggaaacaacaggggtgccagacgtggcccg

SEQ ID NO: 1249 - DNA, 50 bp, Homo sapiens
cgggggaggctgctgagtggttttgaaattatacagagctggatttgaac

SEQ ID NO: 1250 - DNA, 50 bp, Homo sapiens
cttctgtcgtttcaattggcatctggtgaactatgcctaacagcttaacg

SEQ ID NO: 1251 - DNA, 50 bp, Homo sapiens
ggagttcattgctgggtgtgactggagaggtcaggcaggagctctcatcg

SEQ ID NO: 1252 - DNA, 50 bp, Homo sapiens
agattttccctagccctgcagctgccctccatggatggacttgtatctcg

SEQ ID NO: 1253 - DNA, 50 bp, Homo sapiens
ctgctgttcagggaaatggcttcctttcagatgtgtttctcatagtctcg

SEQ ID NO: 1254 - DNA, 50 bp, Homo sapiens
ggcgggacgctgtttcgacactgcaggtagggtgtaaggattgctcatcg

SEQ ID NO: 1255 - DNA, 50 bp, Homo sapiens
tgcctgaaatgatacagtagtgtataaaccaagtatctctgcttgcatcg

SEQ ID NO: 1256 - DNA, 50 bp, Homo sapiens
cggtttgcatctccagcccccgcggctcacaggccgtgtaacttcactgc

SEQ ID NO: 1257 - DNA, 50 bp, Homo sapiens
cggccatattctggcagggtcagtggctccaactaacatttgtttggtac

SEQ ID NO: 1258 - DNA, 50 bp, Homo sapiens
cgaagaattgtatttgcatgtctgaaatgaaagcccagagaatagggtgg

SEQ ID NO: 1259 - DNA, 50 bp, Homo sapiens
tggaaaccccttcagcagcgtatggtgctggggaccttctggggagatcg

SEQ ID NO: 1260 - DNA, 50 bp, Homo sapiens
aaagcatgcagcgtggagggctggtccaggtcaggtggcatcaaagagcg

SEQ ID NO: 1261 - DNA, 50 bp, Homo sapiens
cggtaccccaaaatttggtgctttgacatgctgaactagagaagcagccg

SEQ ID NO: 1262 - DNA, 50 bp, Homo sapiens
cgcattcttgctcccgaatactagccaagtccctacagaggctgatcccg

SEQ ID NO: 1263 - DNA, 50 bp, Homo sapiens
gcagcctctgggtgggtggcggaggctgaggcgatgctgtccaccacacg

SEQ ID NO: 1264 - DNA, 50 bp, Homo sapiens
cgagtctgaaccatctcaactcagaaaacaccagaagaaaaagtgtggag

SEQ ID NO: 1265 - DNA, 50 bp, Homo sapiens
cggtgtttctgcactgttgatcctgctctcgtctctggctacccccactg

SEQ ID NO: 1266 - DNA, 50 bp, Homo sapiens
cgctgaaacttagcaggcactcagtaaatattttgctaagcagttaaaac

SEQ ID NO: 1267 - DNA, 50 bp, Homo sapiens
cgcctgcagaaagtgatctttccgagacaggacgatgtgctcatctcctt

SEQ ID NO: 1268 - DNA, 50 bp, Homo sapiens
agtcaaagtcaaatcatgggtagattccgtcactaacaaagtgagccacg

SEQ ID NO: 1269 - DNA, 50 bp, Homo sapiens
cgtcctgagttcccagacgtcataggtgcttgctcaacgagtgtttgaat

SEQ ID NO: 1270 - DNA, 50 bp, Homo sapiens
ctaccaaagcactggagctcataacaagctgcctgtccttggccacctcg

SEQ ID NO: 1271 - DNA, 50 bp, Homo sapiens
ccactggagatatactctaccctggggagttaagataattgtgagcaccg

SEQ ID NO: 1272 - DNA, 50 bp, Homo sapiens
cgggctggggaggtgtaaagacaaatcccggtgaccctggccctaaaaag

SEQ ID NO: 1273 - DNA, 50 bp, Homo sapiens
cgcgcgtgcttttgagaaggcatatgctgggtgtgtctgtctgtgcctat

SEQ ID NO: 1274 - DNA, 50 bp, Homo sapiens
acgctagtgcagcacttttgaaagtaaaaagcactttgcaataattaacg

SEQ ID NO: 1275 - DNA, 50 bp, Homo sapiens
cgtcgtcctggctaggatctagcatctcagtgcaaaatgggctatgtaag

SEQ ID NO: 1276 - DNA, 50 bp, Homo sapiens
agcccggggtgcaggactcagacagaaacctcagggaggcggggctgacg

SEQ ID NO: 1277 - DNA, 50 bp, Homo sapiens
cggtgattcaagacctccaagaattcctgtggttcccagtaaatccccac

SEQ ID NO: 1278 - DNA, 50 bp, Homo sapiens
cgaggacgccttagggacgttttggggcttaaagccactaaagacgtttc

SEQ ID NO: 1279 - DNA, 50 bp, Homo sapiens
cgcccacacagtttggagttaaacagatctcaacaaatgaacacagttat

SEQ ID NO: 1280 - DNA, 50 bp, Homo sapiens
ctggttcatctcaggtgttgttgctttgtgaacattcactaagctctacg

SEQ ID NO: 1281 - DNA, 50 bp, Homo sapiens
tcttcttagtgagcatgctcatagctaaccttctttgaacttcctcaacg

SEQ ID NO: 1282 - DNA, 50 bp, Homo sapiens
ctatcgcttggggctgttgtgaggcctcggtgagataaccgtgccatgcg

SEQ ID NO: 1283 - DNA, 50 bp, Homo sapiens
tctctcctttgctatgggagggcttgaatctgtggcagccttcaaaaccg

SEQ ID NO: 1284 - DNA, 50 bp, Homo sapiens
cgcctggagcgcctcccactgcagacgtctgtccgcctccagccgctctc

SEQ ID NO: 1285 - DNA, 50 bp, Homo sapiens
cgccgggccaacacaggatctgatagtgcagggtcaacgcctacgtggga

SEQ ID NO: 1286 - DNA, 50 bp, Homo sapiens
cgcgcccccacgcccctgcccacaggcctgcattgaaggcgcttccgctc

SEQ ID NO: 1287 - DNA, 50 bp, Homo sapiens
aaggatggcatccatccgtaaagggcttcctcggtccagcgccaggaacg

SEQ ID NO: 1288 - DNA, 50 bp, Homo sapiens
cgcggccgagctgtctgtccaagcctgggccccagcacccagcgcaagct

SEQ ID NO: 1289 - DNA, 50 bp, Homo sapiens
gagtgttggctcacgtgttcctgagcctgtctgtttttagttagtgtccg

SEQ ID NO: 1290 - DNA, 50 bp, Homo sapiens
cgggcagatacgagcagattgactcgccaggactgtcattgggccaccgc

SEQ ID NO: 1291 - DNA, 50 bp, Homo sapiens
ctgacctcatcccggaggccgcttcagttctcgaatggatgtctcttccg

SEQ ID NO: 1292 - DNA, 50 bp, Homo sapiens
cgccacaggaatggctcttatgatccttttggatggctagatttctgaaa

SEQ ID NO: 1293 - DNA, 50 bp, Homo sapiens
cctcctgtgagcaacctttcggcgtctgcagagctcgtggcgtaagagcg

SEQ ID NO: 1294 - DNA, 50 bp, Homo sapiens
cgacagcaatcccgtgagaaactgtgggacagaaccacccagctaagcag

SEQ ID NO: 1295 - DNA, 50 bp, Homo sapiens
cggcaaaggcagccaattgcttggctgacgaagccaggaaaatcccacat

SEQ ID NO: 1296 - DNA, 50 bp, Homo sapiens
aaagaatgaggtcactgtcaccaatgaagtcaccactgcatgattcatcg

SEQ ID NO: 1297 - DNA, 50 bp, Homo sapiens
tgtggattcctccaaactgtgattgctacatcttaattttcagcaggacg

SEQ ID NO: 1298 - DNA, 50 bp, Homo sapiens
agatactgggggacgtgcttcggttgtcctggtcgatatccctagggtcg

SEQ ID NO: 1299 - DNA, 50 bp, Homo sapiens
tggcaagtcgctcatggaaaccattagtgtccatcagtcatcagaaggcg

SEQ ID NO: 1300 - DNA, 50 bp, Homo sapiens
ccatagcacccccataataaagcagcccgtgagggcagcctggctgttcg

SEQ ID NO: 1301 - DNA, 50 bp, Homo sapiens
cggagcaggccacagtcagggtggaagaaaacgagggaagactgagaaac

SEQ ID NO: 1302 - DNA, 50 bp, Homo sapiens
cggcactgcctgatctggtctctcaagttcaacctcttacaactcatgtg

SEQ ID NO: 1303 - DNA, 50 bp, Homo sapiens
gccttgtcctggggctgagcagtggtgcaacccagccctgaggaattccg

SEQ ID NO: 1304 - DNA, 50 bp, Homo sapiens
ccacctgaggtgagcaatcagaggacacccctcgagtcactgggagttcg

SEQ ID NO: 1305 - DNA, 50 bp, Homo sapiens
cggcacagtcccgcccaccactagaaagcccgctcccgccagctctcgcc

SEQ ID NO: 1306 - DNA, 50 bp, Homo sapiens
agctttgtatagatgcatgcacttggaaaccagcaaagctaaaaataccg

SEQ ID NO: 1307 - DNA, 50 bp, Homo sapiens
cgcaggagcgcacacacgttcccacacgccactcaattccagaacaacgg

SEQ ID NO: 1308 - DNA, 50 bp, Homo sapiens
gtatgtgtgagtcaatctaatgtgccctccctcagcataatcctgtcacg

SEQ ID NO: 1309 - DNA, 50 bp, Homo sapiens
tggaaatctctttcgtcaaggcctctagtgaccgctggggattcttctcg

SEQ ID NO: 1310 - DNA, 50 bp, Homo sapiens
tcatacatttcaacttgctgctgttctgagtagcgtgatgaaatcttgcg

SEQ ID NO: 1311 - DNA, 50 bp, Homo sapiens
cggagtagtcttgaaagacatgacaaatcaccagacctgggaagaagcta

SEQ ID NO: 1312 - DNA, 50 bp, Homo sapiens
ggcggcggggcacagcgtgggggtgtgcagtgactgagagatggttcacg

SEQ ID NO: 1313 - DNA, 50 bp, Homo sapiens
gaatgatctctgcactgtaggacatccttggccctgcctaccaaatgacg

SEQ ID NO: 1314 - DNA, 50 bp, Homo sapiens
cggctgttccagaccctaatgagttcagttgtcctacaaagcaggaagag

SEQ ID NO: 1315 - DNA, 50 bp, Homo sapiens
cggggtgtcactcctacaagacaagaaaagcccaggattgctggccaatg

SEQ ID NO: 1316 - DNA, 50 bp, Homo sapiens
atacacagttccctgcacacactcggctaactgtgaccagggtgagagcg

SEQ ID NO: 1317 - DNA, 50 bp, Homo sapiens
atgaccctgtgactaacatctgtcaggcagctgacaaacagctattcacg

SEQ ID NO: 1318 - DNA, 50 bp, Homo sapiens
ctgttaggcagagcagcctaatgggagcagtgtgactcatggacctcacg

SEQ ID NO: 1319 - DNA, 50 bp, Homo sapiens
tcatccaagcttgtgtgagtcacaatgagcagaaagcattcttccacccg

SEQ ID NO: 1320 - DNA, 50 bp, Homo sapiens
cggccccagcactgcaaagctgtcatcgctcctctccagggagccatcct

SEQ ID NO: 1321 - DNA, 50 bp, Homo sapiens
cggcccatgtgtcgcactcgcctcggctcccacacagccgcctctgctcc

SEQ ID NO: 1322 - DNA, 50 bp, Homo sapiens
ctactttcaatctctatggatttccctattcaggacattttctataaacg

SEQ ID NO: 1323 - DNA, 50 bp, Homo sapiens
tatgcttactccctctccctcttgtctgtgtccctgtgtggcctgaagcg

SEQ ID NO: 1324 - DNA, 50 bp, Homo sapiens
cggagagccaacaccaccagtcagtcacccaagctggaaatttaagcatc

SEQ ID NO: 1325 - DNA, 50 bp, Homo sapiens
cgtctgcaagaacaggggagaactaaggtcccaagcagcaaaagttaaaa

SEQ ID NO: 1326 - DNA, 50 bp, Homo sapiens
cggcatcttcatttgagtgggtgcgggaaggacctcattttggaaccaca

SEQ ID NO: 1327 - DNA, 50 bp, Homo sapiens
cgcgtgcctctgtgcagtcagtgagaagggctcccgttcagaatgggcag

SEQ ID NO: 1328 - DNA, 50 bp, Homo sapiens
cgtgagccagagagagctggctttcagtgttgtcaccatggttactgcta

SEQ ID NO: 1329 - DNA, 50 bp, Homo sapiens
cgactgctcctctggcaagcaggacccatttctaaagcatgagtcactac

SEQ ID NO: 1330 - DNA, 50 bp, Homo sapiens
cgcttcagacgcatctcttctcagtgagtcagctgtgggccccactcagg

SEQ ID NO: 1331 - DNA, 50 bp, Homo sapiens
cggaaaacttgctaatgctggctgattctcattgctgggtttactagttc

SEQ ID NO: 1332 - DNA, 50 bp, Homo sapiens
cgctttatggagcagcaaagaaagtagtttcttgagatgggttctactct

SEQ ID NO: 1333 - DNA, 50 bp, Homo sapiens
taaaattatttttttccctaaacccaatctctcctcttcctcctctgtcg

SEQ ID NO: 1334 - DNA, 50 bp, Homo sapiens
cgctgtcaggaattgtctcctggttcaacccactcctgccttaggcccac

SEQ ID NO: 1335 - DNA, 50 bp, Homo sapiens
cgatggtgagcaaaaggtgttgacaggcctggcatggtgactcacccctg

SEQ ID NO: 1336 - DNA, 50 bp, Homo sapiens
tccaagtcacacagcccttaaatgagccaccaggttacctttgcatcacg

SEQ ID NO: 1337 - DNA, 50 bp, Homo sapiens
cggaggcccagagaagggaagtgacatgctcaaggtaacactgctaacca

SEQ ID NO: 1338 - DNA, 50 bp, Homo sapiens
cgtgaggttgtgtcttactgagctcacatcataattcctgtgtgcacaga

SEQ ID NO: 1339 - DNA, 50 bp, Homo sapiens
cgaggacagttcctccagaaatccaggtcagtcacaagacaaagaaaaga

SEQ ID NO: 1340 - DNA, 50 bp, Homo sapiens
cggcctctgagagctgacacggaacttgcatcatttctgatgcttggctc

SEQ ID NO: 1341 - DNA, 50 bp, Homo sapiens
agaggaagcggcagtggcagcgtggcaggcagcgggcgggttctaggtcg

SEQ ID NO: 1342 - DNA, 50 bp, Homo sapiens
cgtgccttctcgcgctccgatcacctggcgctgcacatgaaacggcacat

SEQ ID NO: 1343 - DNA, 50 bp, Homo sapiens
tcagaacagtgcgggctagaggcgcacacgtttcatctaggcttcgggcg

SEQ ID NO: 1344 - DNA, 50 bp, Homo sapiens
ataaaagcaacccagggagctatttggtggcttctggcttctgactgccg

SEQ ID NO: 1345 - DNA, 50 bp, Homo sapiens
ggtgctcactggctccagacgtggatctgcagctgggaatcaagtgatcg

SEQ ID NO: 1346 - DNA, 50 bp, Homo sapiens
tttcccagtcagcaggatgggcactgcagatgtgtgtctgcatgccagcg

SEQ ID NO: 1347 - DNA, 50 bp, Homo sapiens
cgggctctcacacgtgggccaccatccgcctgccccagtcaccccggggc

SEQ ID NO: 1348 - DNA, 50 bp, Homo sapiens
cgcaggcaggtagaggtcccaagtctattcagggcctcatttgtgactga

SEQ ID NO: 1349 - DNA, 50 bp, Homo sapiens
agaaagcaccacaggtaataaaaacacctaaaaaggtcagcagaaactcg

SEQ ID NO: 1350 - DNA, 50 bp, Homo sapiens
cgcaacccccagtgacacaacccccagtgacgcaaccccgccacccaatg

SEQ ID NO: 1351 - DNA, 50 bp, Homo sapiens
cgaggagcgggcgtgctgcgctgcttctctttgagtcatctgggtcctcg

SEQ ID NO: 1352 - DNA, 50 bp, Homo sapiens
cgacaatgtaagcctcgccccctgcctgttgctctcgtccccacggcctg

SEQ ID NO: 1353 - DNA, 50 bp, Homo sapiens
cggccacggcgggcactcagcatttcctgatgacagaacagtgccgttgg

SEQ ID NO: 1354 - DNA, 50 bp, Homo sapiens
cgcaaaagccttgcaacacacaacagcacagacaaaccccgcagacacgg

SEQ ID NO: 1355 - DNA, 50 bp, Homo sapiens
atttcgaaataaaggagcttgcatgaatgacgatttccaaacttctctcg

SEQ ID NO: 1356 - DNA, 50 bp, Homo sapiens
cctgcgctctgacaccagccgtgtaagggcacagactcggctgctgttcg

SEQ ID NO: 1357 - DNA, 50 bp, Homo sapiens
cgttcagatctgttgcgactcttcagatcacttcccgttttgcaatcacg

SEQ ID NO: 1358 - DNA, 50 bp, Homo sapiens
cacatcctgccccctgagcagtggagagccacacgtgtggaaatcttgcg

SEQ ID NO: 1359 - DNA, 50 bp, Homo sapiens
cgcccactttgccggtgggacagagtggctgacggcgtgtggcacaggcg

SEQ ID NO: 1360 - DNA, 50 bp, Homo sapiens
cgcactaacgtgaatgccgcatgtacagatgaccacagtgctcggagggt

SEQ ID NO: 1361 - DNA, 50 bp, Homo sapiens
gagtggcagaggcgagaacggatcgctggaggcccgacgtctcgttcacg

SEQ ID NO: 1362 - DNA, 50 bp, Homo sapiens
atatttaaggcatcgcccctcagggagccgagcactgatttccacagccg

SEQ ID NO: 1363 - DNA, 50 bp, Homo sapiens
cgtgcgtgctccatctcccgcagccgagccgcccattgctcatcttttgc

SEQ ID NO: 1364 - DNA, 50 bp, Homo sapiens
agcgggtaagtaatgcattcaaggttgcacaactagtaaatgcttcatcg

SEQ ID NO: 1365 - DNA, 50 bp, Homo sapiens
cgtgggatcccatgccaccttcctgccaaatgaccatgtgtaaattgctt

SEQ ID NO: 1366 - DNA, 50 bp, Homo sapiens
cgaaccaggaactctcttattccatggactgtggtctgggtcagtaggct

SEQ ID NO: 1367 - DNA, 50 bp, Homo sapiens
cggcttctttaattgtgcaatctgtgtcagtggggaagcacaaataggat

SEQ ID NO: 1368 - DNA, 50 bp, Homo sapiens
cggagattgcccaaccaaagagcagaagttcacagaatatctcttcttgg

SEQ ID NO: 1369 - DNA, 50 bp, Homo sapiens
cgggctccaccacgaagcgcagcttgccatctgcgagctgctccagcgcg

SEQ ID NO: 1370 - DNA, 50 bp, Homo sapiens
gtatttgttacagcagtaccctattccccgtaccaaaaatctgtgttacg

SEQ ID NO: 1371 - DNA, 50 bp, Homo sapiens
aatgatgaaatccagccattctgacactgttccttatctaggatctctcg

SEQ ID NO: 1372 - DNA, 50 bp, Homo sapiens
gagtctggagagagcaatgtctccatggagcgggtgcctggctgtggtcg

SEQ ID NO: 1373 - DNA, 50 bp, Homo sapiens
cggcgaatctcatcaaactttgagaaaaaaaaacagctcatcacagagat

SEQ ID NO: 1374 - DNA, 50 bp, Homo sapiens
cgccagcaaggtgcatgatcgtccaccagggcaccattctggataatgtt

SEQ ID NO: 1375 - DNA, 50 bp, Homo sapiens
cggatgaggtctgcagttgccccaccttactatcttgagagttcccaggg

SEQ ID NO: 1376 - DNA, 50 bp, Homo sapiens
acgaatttaagctttatgccacaatttcccaattcaacataaagctaacg

SEQ ID NO: 1377 - DNA, 50 bp, Homo sapiens
gttttgtttcctcataccttacattgtgaaatacaaaattagctaatgcg

SEQ ID NO: 1378 - DNA, 50 bp, Homo sapiens
cgcgacgcgctcatctgccacccacacgaagacaaaacacaatggttatg

SEQ ID NO: 1379 - DNA, 50 bp, Homo sapiens
cagaggccagagacttgaatttacaaggagggtcctcaacacagacatcg

SEQ ID NO: 1380 - DNA, 50 bp, Homo sapiens
accctggtatttcatcactttcttgcctaacttagcagaaacatgtatcg

SEQ ID NO: 1381 - DNA, 50 bp, Homo sapiens
gttacactataaatagatgttcactgaccaaatactcctactagttctcg

SEQ ID NO: 1382 - DNA, 50 bp, Homo sapiens
cggcattgatgttgcttcacgttgctgatgcttaagcaatgtatattgtg

SEQ ID NO: 1383 - DNA, 50 bp, Homo sapiens
cgtcgtctttaaaatgtgctatcatttccttgttatagttgtgcaagatt

SEQ ID NO: 1384 - DNA, 50 bp, Homo sapiens
tggctccagtttccaagtgacgcaaccaagtgtctggattcagagaatcg

SEQ ID NO: 1385 - DNA, 50 bp, Homo sapiens
acaaatgtaaaagcctggcagcttccccaggagagtgcgggtatgggccg

SEQ ID NO: 1386 - DNA, 50 bp, Homo sapiens
catagtggcgtgtcgtaataatctggcagctggtccagctggtagtgccg

SEQ ID NO: 1387 - DNA, 50 bp, Homo sapiens
cgccggccaaatgcaaccagcagagatatgaccccgacccgtctaaagcc

SEQ ID NO: 1388 - DNA, 50 bp, Homo sapiens
tggggccaacaggcatgattaccacacaggatgttaggcaaggggttccg

The invention claimed is:

1. A kit for distinguishing granulocytes from other blood cell types in a biological sample, the kit comprising:
   a) a normalization standard comprising a nucleic acid molecule having at least one marker-region, wherein said marker-region has the sequence of a bisulfite-converted or bisulfite-unconverted genomic DNA sequence of SEQ ID NO: 518, 685, 686, or 517 and at least one control-region, wherein said marker-region and said control-region are present in the same number of copies on said nucleic acid molecule;
   wherein said at least one control-region is cell-unspecific and is selected from genes that are expressed in all blood cell types; and
   b) a natural blood cell sample of known composition, wherein said control-region comprises a sequence of a bisulfite-converted or a bisulfite-unconverted genomic region that is present in the same number of copies in the genome of each cell of said natural blood cell sample of known composition.

2. The kit according to claim 1, wherein the nucleic acid molecule is selected from a plasmid, a yeast artificial chromosome (YAC), human artificial chromosome (HAC), P1-derived artificial chromosome (PAC), a bacterial artificial chromosome (BAC), or a PCR-product.

3. The kit according to claim 1, wherein the marker-region discriminates granulocytes from leukocytes, T-lymphocytes, monocytes, B-lymphocytes and/or Natural Killer (NK) cells.

4. The kit according to claim 1, wherein the normalization standard comprises marker-regions and/or control-regions that have at least one bisulfite-convertible CpG position in the corresponding genomic loci from blood cells.

5. The kit according to claim 1, wherein the at least one marker-region comprises the sequence of the bisulfite-converted or bisulfite-unconverted genomic DNA sequence of SEQ ID NO: 685 or 686.

6. The kit according to claim 1, further comprising at least one additional marker-region comprising the sequence of a bisulfite-converted or bisulfite-unconverted genomic DNA sequence selected from SEQ ID NOs: 687-689.

7. The kit according to claim 1, wherein said at least one marker-region comprises:
   a) the marker-region having the sequence of the bisulfite converted or bisulfite unconverted genomic DNA sequence of SEQ ID NO: 517 and at least one additional marker region comprising the sequence of a bisulfite converted or bisulfite unconverted genomic DNA sequence selected from SEQ ID NOs: 1-516 and 518-689;
   b) the marker-region having the sequence of the bisulfite converted or bisulfite unconverted genomic DNA sequence of SEQ ID NO: 518 and at least one additional marker region comprising the sequence of a bisulfite converted or bisulfite unconverted genomic DNA sequence selected from SEQ ID NOs: 1-517 and 519-689;
   c) the marker-region having the sequence of the bisulfite converted or bisulfite unconverted genomic DNA sequence of SEQ ID NO: 685 and at least one additional marker region comprising the sequence of a bisulfite converted or bisulfite unconverted genomic DNA sequence selected from SEQ ID NOs: 1-684 and 686-689; or
   d) the marker-region having the sequence of the bisulfite converted or bisulfite unconverted genomic DNA sequence of SEQ ID NO: 686 and at least one additional marker region comprising the sequence of a bisulfite converted or bisulfite unconverted genomic DNA sequence selected from SEQ ID NOs: 1-685 and 687-689.

8. A kit for distinguishing granulocytes from other blood cell types in a biological sample, the kit comprising:
   a) a normalization standard comprising a nucleic acid molecule having a marker-region wherein said marker-region has the sequence of a bisulfite-converted or bisulfite-unconverted genomic DNA sequence of SEQ ID NO: 685 and at least one control-region, wherein the marker-region and the at least one control-region are present in the same number of copies on the nucleic acid molecule;
   and wherein the at least one control-region is cell non-specific and is selected from genes that are expressed in all blood cell types; and
   b) a natural blood cell sample of known composition, wherein said control-region comprises the sequence of a bisulfate-converted or a bisulfite-unconverted genomic region that is present in the same number of copies in the genome of each cell of said natural blood cell sample of known composition.

9. The kit according to claim 8, wherein the nucleic acid molecule is selected from a plasmid, a yeast artificial chromosome (YAC), human artificial chromosome (HAC), P1-derived artificial chromosome (PAC), a bacterial artificial chromosome (BAC), or a PCR-product.

10. The kit according to claim 8, wherein the normalization standard comprises the marker-region and the at least one control-region that has at least one bisulfite-convertible CpG position in the corresponding genomic loci from blood cells.

11. The kit according to claim 8, further comprising at least one additional marker-region for distinguishing granulocytes from the other blood cell types, wherein the at least one additional marker-region has the sequence of a bisulfite-converted or bisulfite-unconverted genomic DNA sequence of SEQ ID NOs: 518, 686, or 517.

12. The kit according to claim 8, further comprising at least one additional marker-region for distinguishing granulocytes from the other blood cell types, wherein the at least one additional marker-region has the sequence of a bisulfite-converted or bisulfite-unconverted genomic DNA sequence of SEQ ID NOs: 1051-1240.

13. The kit according to claim 8, further comprising at least one additional marker-region for distinguishing granulocytes and/or an additional blood cell type from the other blood cell types, wherein the at least one additional marker-region has the sequence of a bisulfate-converted or bisulfate-unconverted selected from a sequence corresponding to the genomic DNA sequence of SEQ ID NOs: 1-684 and 685-689.

* * * * *